US011466096B2

(12) United States Patent
Kim et al.

(10) Patent No.: US 11,466,096 B2
(45) Date of Patent: Oct. 11, 2022

(54) ANTIBODY CONJUGATES AND METHODS OF MAKING AND USING THE SAME

(71) Applicant: R.P. Scherer Technologies, LLC, Carson City, NV (US)

(72) Inventors: Yun Cheol Kim, Walnut Creek, CA (US); Chao Bai Huang, San Leandro, CA (US); Penelope M. Drake, Castro Valley, CA (US); David Rabuka, Kensington, CA (US)

(73) Assignee: R.P. Scherer Technologies, LLC, Carson City, NV (US)

( * ) Notice: Subject to any disclaimer, the term of this patent is extended or adjusted under 35 U.S.C. 154(b) by 263 days.

(21) Appl. No.: 16/491,124

(22) PCT Filed: Mar. 13, 2018

(86) PCT No.: PCT/US2018/022178
§ 371 (c)(1),
(2) Date: Sep. 4, 2019

(87) PCT Pub. No.: WO2018/169953
PCT Pub. Date: Sep. 20, 2018

(65) Prior Publication Data
US 2020/0010561 A1 Jan. 9, 2020

Related U.S. Application Data

(60) Provisional application No. 62/473,161, filed on Mar. 17, 2017.

(51) Int. Cl.
*C07K 16/30* (2006.01)
*A61K 47/68* (2017.01)
*A61K 47/60* (2017.01)
*A61K 49/00* (2006.01)

(52) U.S. Cl.
CPC .............. *C07K 16/30* (2013.01); *A61K 47/60* (2017.08); *A61K 47/6803* (2017.08); *A61K 47/6851* (2017.08); *A61K 49/0002* (2013.01); *C07K 2317/52* (2013.01)

(58) Field of Classification Search
CPC ...... C07K 16/30; C07K 2317/52; C07K 1/13; C07K 16/00; A61K 47/60; A61K 47/6803; A61K 47/6851; A61K 49/0002; A61K 47/6849; A61K 47/65; A61K 47/6889
See application file for complete search history.

(56) References Cited

U.S. PATENT DOCUMENTS

| 7,985,783 | B2 | 7/2011 | Carrico et al. |
| 8,729,232 | B2 | 5/2014 | Rush et al. |
| 9,238,878 | B2 | 1/2016 | Rabuka et al. |
| 9,540,438 | B2* | 1/2017 | Barfield ............... C07K 1/1077 |
| 9,879,249 | B2 | 1/2018 | Rabuka et al. |
| 10,183,998 | B2 | 1/2019 | Barfield et al. |
| 2002/0052480 | A1* | 5/2002 | Park ....................... C07K 16/40 424/183.1 |
| 2008/0187956 | A1 | 8/2008 | Carrico et al. |
| 2012/0183566 | A1* | 7/2012 | Barfield ............. A61K 47/6849 530/391.1 |
| 2014/0141025 | A1 | 5/2014 | Kudirka et al. |
| 2015/0157736 | A1 | 6/2015 | Rabuka et al. |
| 2015/0352225 | A1* | 12/2015 | Rabuka ............... A61K 47/6889 530/391.1 |
| 2015/0368347 | A1* | 12/2015 | Bukhalid ................. A61P 43/00 424/139.1 |
| 2017/0306300 | A1 | 10/2017 | Kim et al. |

FOREIGN PATENT DOCUMENTS

| EP | 1391213 | 2/2004 |
| WO | WO 2008/036350 | 3/2008 |
| WO | WO 2012/097333 | 7/2012 |
| WO | WO-2012097333 A2 * | 7/2012 | .............. A61P 35/00 |
| WO | WO 2014/074218 | 5/2014 |

OTHER PUBLICATIONS

Drake et al., Bioconjugate Chemistry 25: 1331-1341 (Year: 2014).*
Strop et al., Chem Biol 20: 161-167 (Year: 2013).*
Lloyd et al. Protein Engineering, Design & Selection 22:159-168 (Year: 2009).*
Edwards et al., J Mol Biol. Nov. 14, 2003;334(1): 103-118 (Year: 2003).*
Yu et al., Investigative Ophthalmology & Visual Science 49(2): 522-527 (Year: 2008).*
Cosma et al., (2003) "The Multiple Sulfatase Deficiency Gene Encodes an Essential and Limiting Factor for the Activity of Sulfatases", Cell vol. 113: 445-456.
Dierks et al., (1998) "Conversion of Cysteine to Formylglycine in Eukaryotic Sulfatases Occurs by a Common Mechanism in the Endoplasmic Reticulum", FEBS Letters 423(1): 61-65.
Dierks et al., (1999) "Sequence Determinants Directing Conversion of Cysteine to Formylglycine in Eukaryotic Sulfatases", EMBO J. 18(8): 2084-2091.

(Continued)

*Primary Examiner* — Phuong Huynh
(74) *Attorney, Agent, or Firm* — Rudy J. Ng; Carol L. Francis; Bozicevic, Field & Francis LLP

(57) ABSTRACT

Antibodies that include a sulfatase motif-containing tag in a constant region of an immunoglobulin (Ig) heavy chain polypeptide are disclosed. The sulfatase motif can be converted by a formylglycine-generating enzyme (FGE) to produce a formylglycine (fGly)-modified Ig heavy chain polypeptide. An fGly-modified Ig heavy chain polypeptide of the antibody can be covalently and site-specifically bound to a moiety of interest to provide an antibody conjugate. The disclosure also encompasses methods of production of such tagged Ig heavy chain polypeptides, fGly-modified Ig heavy chain polypeptides, and antibody conjugates, as well as methods of use of same.

26 Claims, 63 Drawing Sheets

Specification includes a Sequence Listing.

(56) References Cited

OTHER PUBLICATIONS

Dierks et al., (2003) "Multiple Sulfatase Deficiency is Caused by Mutations in the Gene Encoding the Human C (apha)-Formylglycine Generating Enzyme", Cell 113: 435-444.
Preusser et al., (2005) "Molecular Characterization of the Human C(alpha)-Formylglycine Generating Enzyme", J. Biol. Chem. 280(15): 14900-14910.
Preusser et al., (2005) "Chemistry in Living Systems", Nat. Chem. Bio. 1(1): 13-21.

* cited by examiner

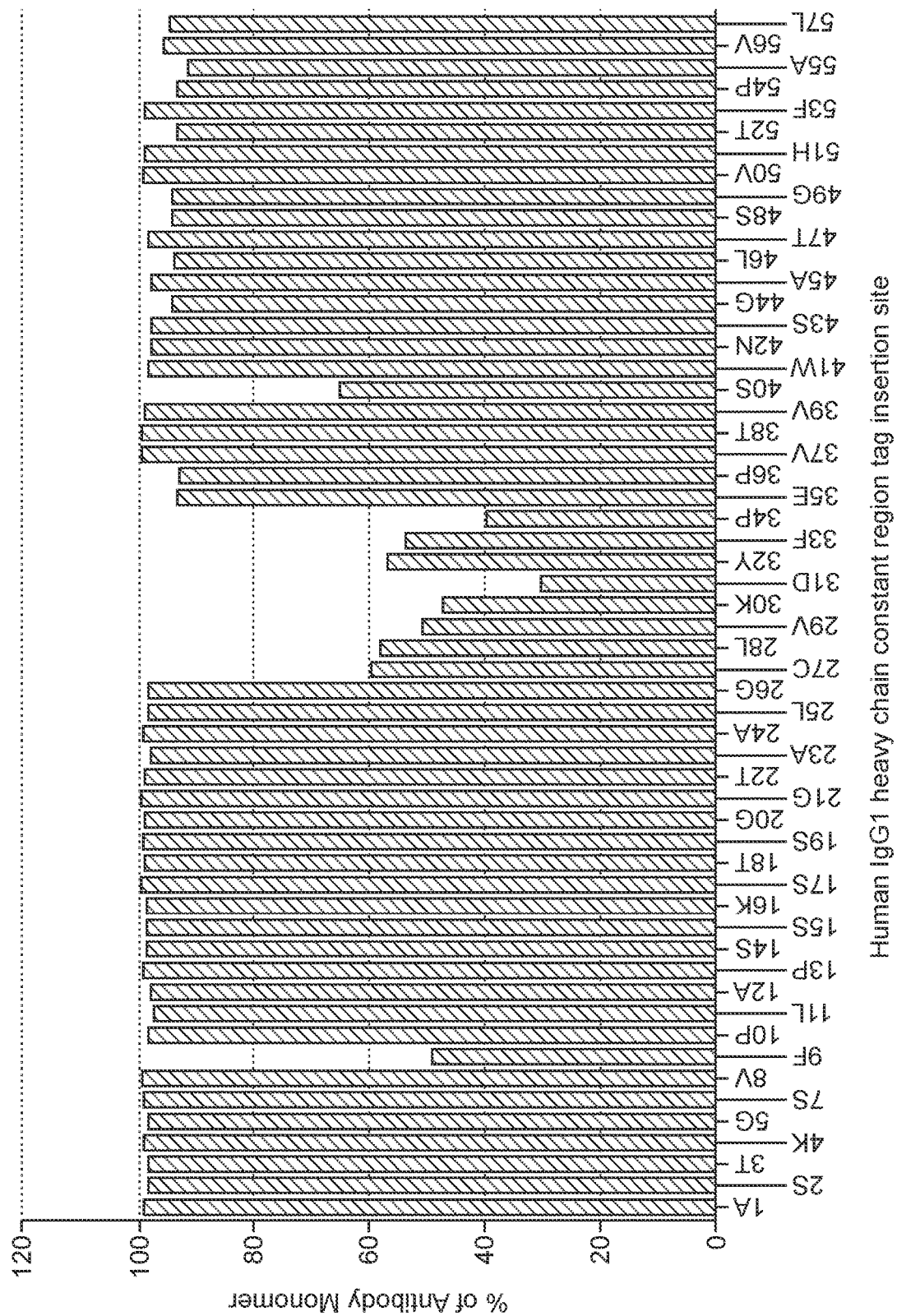

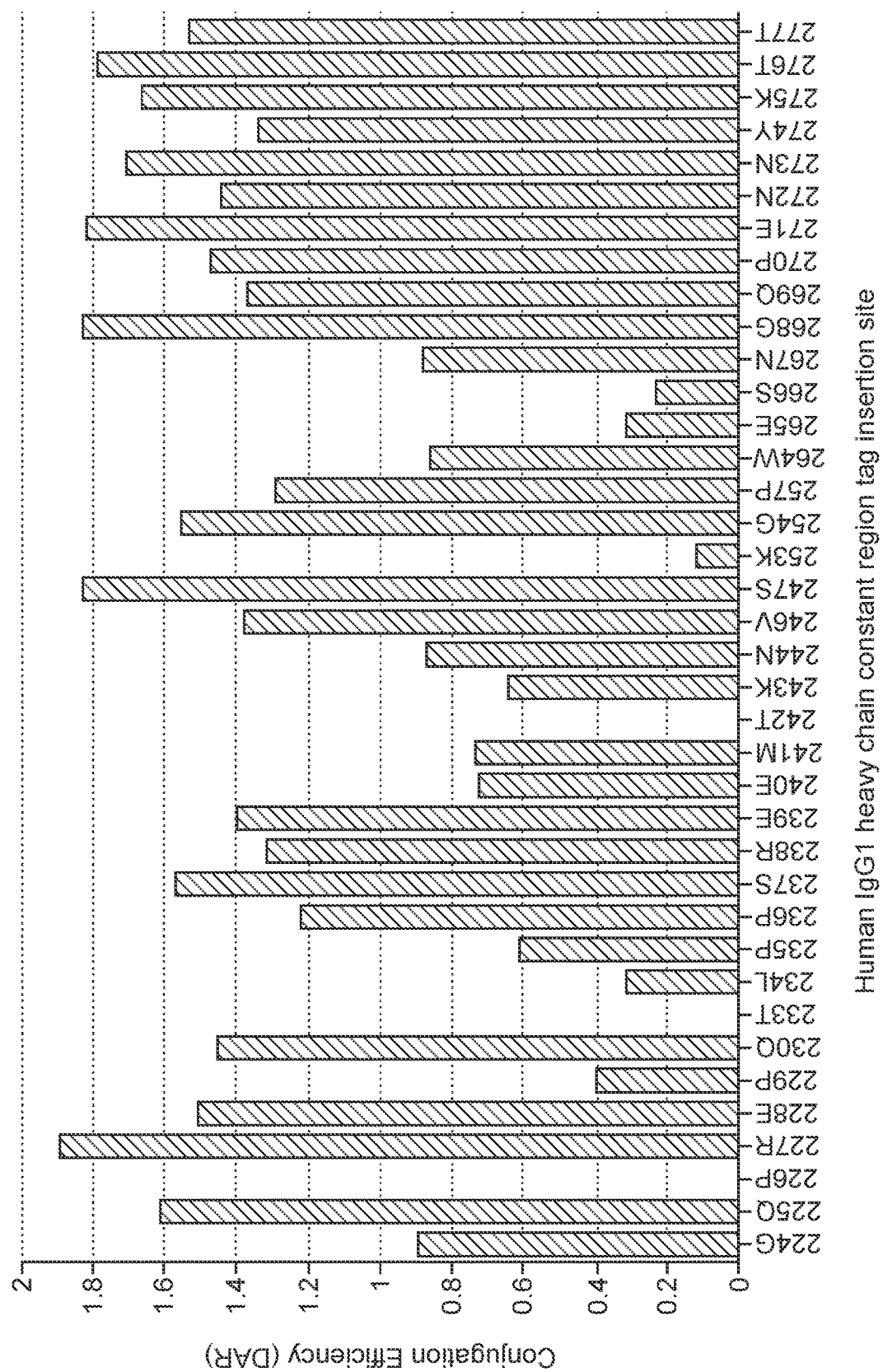

FIG. 11

Table 5

| Tag Position | Expression (mg/L) | mAb % monomer | ADC % monomer | DAR by HIC | DAR2 Retention Time (Standard HIC) |
|---|---|---|---|---|---|
| 4K | 67.79 | 63.3 | 85.1 | 1.53 | 5.092 |
| 8V | 20.00 | - | 88.4 | 0.94 | 5.070 |
| 14S | 63.75 | 97.5 | 93.7 | ND | - |
| 24A | 58.39 | 92.5 | 89.9 | 1.76 | 4.806 |
| 45A | 70.81 | 94.3 | 92.7 | 1.78 | 4.158 |
| 60S | 24.00 | 71.10 | 70.6 | 1.32 | 4.213 |
| 61G | 56.75 | 79.1 | 92.3 | 1.17 | 4.948 |
| 63Y | 63.32 | 72.4 | 97.1 | 1.90 | 5.468 |
| 91N | 52.51 | 81.1 | 92.6 | 1.84 | 4.063 |
| 92T | 55.25 | 86.6 | 89.3 | 1.71 | 4.610 |
| 93K | 47.88 | 92.6 | 91.1 | 1.36 | 4.856 |
| 94V | 74.02 | 87.2 | 93.2 | 1.83 | 4.793 |
| 115P | 71.56 | 90.5 | 90.9 | 1.67 | 4.288 |
| 116E | 70.00 | 94 | 89.4 | - | - |
| 185V | 48.00 | ND | | | |
| 227R | 67.95 | 78.8 | 77.2 | 1.89 | 5.479 |
| 247S | 57.86 | 79.2 | 89.8 | 1.69 | 6.067 |
| 268G | 62.07 | 75.8 | 91.8 | 1.92 | 5.348 |
| 271E | 47.85 | 71.6 | 90.8 | 1.88 | 5.755 |
| 273N | 56.80 | 81.1 | 80.2 | 1.68 | 5.696 |
| 275K | 58.86 | 66.2 | 87.3 | 1.70 | 5.493 |
| 276T | 69.29 | 83.1 | 89.9 | 1.81 | 4.867 |
| 284D | 63.87 | 90.4 | 78.6 | ND | - |
| 329G | 65.83 | 65.7 | 92.2 | 1.88 | 5.554 |
| 331X | 56.10 | 79.4 | 89.7 | 1.84 | 6.135 |

FIG. 12

Table 6

| Tag Position | Expression (mg/L) | mAb % monomer | ADC % monomer | DAR by HIC | DAR2 Retention Time (Standard HIC) |
|---|---|---|---|---|---|
| 8V | 83.66 | 91.2 | 91.6 | 1.84 | 7.693 |
| 14S | 83.68 | 98.5 | 93.7 | 1.40 | 6.012 |
| 60S | 95.67 | 78.6 | 97.9 | 1.67 | 6.564 |
| 61G | 110.50 | 41.3 | 97.5 | ND | - |
| 91N | 102.50 | 81.4 | 97.7 | 1.67 | 7.408 |
| 92T | 115.00 | 83 | 88.7 | 1.40 | 7.416 |
| 185V | 108.80 | 77.5 | 91.6 | 1.81 | 5.743 |
| 276T | 120.20 | 72.7 | 98.5 | 1.70 | 6.960 |

FIG. 13

```
        |         |         |         |         |         |
IgG1  ASTKGPSVFPLAPSSKSTSGGTAALGCLVKDYFPEPVTVSWNSGALTSGVHTFPAVLQSS  60
IgG2  ASTKGPSVFPLAPCSRSTSESTAALGCLVKDYFPEPVTVSWNSGALTSGVHTFPAVLQSS  60
IgG3  ASTKGPSVFPLAPCSRSTSGGTAALGCLVKDYFPEPVTVSWNSGALTSGVHTFPAVLQSS  60
IgG4  ASTKGPSVFPLAPCSRSTSESTAALGCLVKDYFPEPVTVSWNSGALTSGVHTFPAVLQSS  60

|         |         |         |         |         |
IgG1  GLYSLSSVVTVPSSSLGTQTYICNVNHKPSNTKVDKKVE---------------------  99
IgG2  GLYSLSSVVTVPSSNFGTQTYTCNVDHKPSNTKVDKTVERKC------------------ 102
IgG3  GLYSLSSVVTVPSSSLGTQTYTCNVNHKPSNTKVDKRVELKTPLGDTTHTCPRCPEPKSC 120
IgG4  GLYSLSSVVTVPSSSLGTKTYTCNVDHKPSNTKVDKRVESKY------------------ 102

|         |         |         |         |         |
IgG1  ------------------------------PKSCDKTHTCPPCPAPELLGGPSVFLFPPKPKDT 133
IgG2  ------------------------------CVECPPCPAPPV-AGPSVFLFPPKPKDT 129
IgG3  DTPPPCPRCPEPKSCDTPPPCPRCPEPKSCDTPPPCPRCPAPELLGGPSVFLFPPKPKDT 180
IgG4  ------------------------------GPPCPSCPAPEFLGGPSVFLFPPKPKDT 130

|         |         |         |         |         |
IgG1  LMISRTPEVTCVVVDVSHEDPEVKFNWYVDGVEVHNAKTKPREEQYNSTYRVVSVLTVLH 193
IgG2  LMISRTPEVTCVVVDVSHEDPEVQFNWYVDGVEVHNAKTKPREEQFNSTFRVVSVLTVVH 189
IgG3  LMISRTPEVTCVVVDVSHEDPEVQFKWYVDGVEVHNAKTKPREEQYNSTFRVVSVLTVLH 240
IgG4  LMISRTPEVTCVVVDVSQEDPEVQFNWYVDGVEVHNAKTKPREEQFNSTYRVVSVLTVLH 190

|         |         |         |         |         |
IgG1  QDWLNGKEYKCKVSNKALPAPIEKTISKAKGQPREPQVYTLPPSREEMTKNQVSLTCLVK 253
IgG2  QDWLNGKEYKCKVSNKGLPAPIEKTISKTKGQPREPQVYTLPPSREEMTKNQVSLTCLVK 249
IgG3  QDWLNGKEYKCKVSNKALPAPIEKTISKTKGQPREPQVYTLPPSREEMTKNQVSLTCLVK 300
IgG4  QDWLNGKEYKCKVSNKGLPSSIEKTISKAKGQPREPQVYTLPPSQEEMTKNQVSLTCLVK 250

|         |         |         |         |         |
IgG1  GFYPSDIAVEWESNGQPENNYKTTPPVLDSDGSFFLYSKLTVDKSRWQQGNVFSCSVMHE 313
IgG2  GFYPSDISVEWESNGQPENNYKTTPPMLDSDGSFFLYSKLTVDKSRWQQGNVFSCSVMHE 309
IgG3  GFYPSDIAVEWESSGQPENNYNTTPPMLDSDGSFFLYSKLTVDKSRWQQGNIFSCSVMHE 360
IgG4  GFYPSDIAVEWESNGQPENNYKTTPPVLDSDGSFFLYSRLTVDKSRWQEGNVFSCSVMHE 310

|
IgG1  ALHNHYTQKSLSLSPGK 330 (SEQ ID NO:1)
IgG2  ALHNHYTQKSLSLSPGK 326 (SEQ ID NO:2)
IgG3  ALHNRFTQKSLSLSPGK 377 (SEQ ID NO:3)
IgG4  ALHNHYTQKSLSLSLGK 327 (SEQ ID NO:4)
```

FIG. 14 hIgG1 heavy chain constant region
ASTKGPSVFPLAPSSKSTSGGTAALGCLVKDYFPEPVTVSWNSGALTSGVHTFPAVLQSSGLYSLSSVVT
VPSSSLGTQTYICNVNHKPSNTKVDKKVEPKSCDKTHTCPPCPAPELLGGPSVFLFPPKPKDTLMISRTP
EVTCVVVDVSHEDPEVKFNWYVDGVEVHNAKTKPREEQYNSTYRVVSVLTVLHQDWLNGKEYKCKVSNKA
LPAPIEKTISKAKGQPREPQVYTLPPSREEMTKNQVSLTCLVKGFYPSDIAVEWESNGQPENNYKTTPPV
LDSDGSFFLYSKLTVDKSRWQQGNVFSCSVMHEALHNHYTQKSLSLSPGK (SEQ ID NO 1)

hIgG2 heavy chain constant region
ASTKGPSVFPLAPCSRSTSESTAALGCLVKDYFPEPVTVSWNSGALTSGVHTFPAVLQSSGLYSLSSVVT
VPSSNFGTQTYTCNVDHKPSNTKVDKTVERKCCVECPPCPAPPVAGPSVFLFPPKPKDTLMISRTPEVTC
VVVDVSHEDPEVQFNWYVDGVEVHNAKTKPREEQFNSTFRVVSVLTVVHQDWLNGKEYKCKVSNKGLPAP
IEKTISKTKGQPREPQVYTLPPSREEMTKNQVSLTCLVKGFYPSDISVEWESNGQPENNYKTTPPMLDSD
GSFFLYSKLTVDKSRWQQGNVFSCSVMHEALHNHYTQKSLSLSPGK (SEQ ID NO 2)

hIgG3 heavy chain constant region
ASTKGPSVFPLAPCSRSTSGGTAALGCLVKDYFPEPVTVSWNSGALTSGVHTFPAVLQSSGLYSLSSVVT
VPSSSLGTQTYTCNVNHKPSNTKVDKRVELKTPLGDTTHTCPRCPEPKSCDTPPPCPRCPEPKSCDTPPP
CPRCPEPKSCDTPPPCPRCPAPELLGGPSVFLFPPKPKDTLMISRTPEVTCVVVDVSHEDPEVQFKWYVD
GVEVHNAKTKPREEQYNSTFRVVSVLTVLHQDWLNGKEYKCKVSNKALPAPIEKTISKTKGQPREPQVYT
LPPSREEMTKNQVSLTCLVKGFYPSDIAVEWESSGQPENNYNTTPPMLDSDGSFFLYSKLTVDKSRWQQG
NIFSCSVMHEALHNRFTQKSLSLSPGK (SEQ ID NO 3)

hIgG4 heavy chain constant region
ASTKGPSVFPLAPCSRSTSESTAALGCLVKDYFPEPVTVSWNSGALTSGVHTFPAVLQSSGLYSLSSVVT
VPSSSLGTKTYTCNVDHKPSNTKVDKRVESKYGPPCPSCPAPEFLGGPSVFLFPPKPKDTLMISRTPEVT
CVVVDVSQEDPEVQFNWYVDGVEVHNAKTKPREEQFNSTYRVVSVLTVLHQDWLNGKEYKCKVSNKGLPS
SIEKTISKAKGQPREPQVYTLPPSQEEMTKNQVSLTCLVKGFYPSDIAVEWESNGQPENNYKTTPPVLDS
DGSFFLYSRLTVDKSRWQEGNVFSCSVMHEALHNHYTQKSLSLSLGK (SEQ ID NO 4)

FIG. 15

| Table 7: CH1 Insertions |||
|---|---|---|
| Position | Sequence | SEQ ID NO: |
| 1A | LCTPSRASTKGPSVFPLAPSSKSTSGGTAALGCLVKDYFPEPVTVSWNSGALT SGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 5 |
| 2S | ALCTPSRSTKGPSVFPLAPSSKSTSGGTAALGCLVKDYFPEPVTVSWNSGALT SGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 6 |
| 4K | ASTLCTPSRKGPSVFPLAPSSKSTSGGTAALGCLVKDYFPEPVTVSWNSGALT SGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 7 |
| 5G | ASTKLCTPSRGPSVFPLAPSSKSTSGGTAALGCLVKDYFPEPVTVSWNSGALT SGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 8 |
| 7S | ASTKGPLCTPSRVFPLAPSSKSTSGGTAALGCLVKDYFPEPVTVSWNSGALT SGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 9 |

FIG. 15 (Cont.)

| Table 7: CH1 Insertions | | |
|---|---|---|
| Position | Sequence | SEQ ID NO: |
| 8V | ASTKGPSLCTPSRVFPLAPSSKSTSGGTAALGCLVKDYFPEPVTVSWNSGALT SGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 10 |
| 9F | ASTKGPSVLCTPSRFPLAPSSKSTSGGTAALGCLVKDYFPEPVTVSWNSGALT SGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 11 |
| 14S | ASTKGPSVFPLAPLCTPSRSSKSTSGGTAALGCLVKDYFPEPVTVSWNSGALT SGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 12 |
| 15S | ASTKGPSVFPLAPSLCTPSRSKSTSGGTAALGCLVKDYFPEPVTVSWNSGALT SGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 13 |
| 16K | ASTKGPSVFPLAPSSLCTPSRKSTSGGTAALGCLVKDYFPEPVTVSWNSGALT SGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 14 |

FIG. 15 (Cont.)

| Table 7: CH1 Insertions | | |
|---|---|---|
| Position | Sequence | SEQ ID NO: |
| 17S | ASTKGPSVFPLAPSSKLCTPSRSTSGGTAALGCLVKDYFPEPVTVSWNSGALT SGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 15 |
| 18T | ASTKGPSVFPLAPSSKSLCTPSRTSGGTAALGCLVKDYFPEPVTVSWNSGALT SGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 16 |
| 19S | ASTKGPSVFPLAPSSKSTLCTPSRSGGTAALGCLVKDYFPEPVTVSWNSGALT SGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 17 |
| 20G | ASTKGPSVFPLAPSSKSTSLCTPSRGGTAALGCLVKDYFPEPVTVSWNSGALT SGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 18 |
| 21G | ASTKGPSVFPLAPSSKSTSGLCTPSRGTAALGCLVKDYFPEPVTVSWNSGALT SGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 19 |

FIG. 15 (Cont.)

| | Table 7: CH1 Insertions | |
|---|---|---|
| Position | Sequence | SEQ ID NO: |
| 22T | ASTKGPSVFPLAPSSKSTSGGLCTPSRTAALGCLVKDYFPEPVTVSWNSGALT SGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 20 |
| 23A | ASTKGPSVFPLAPSSKSTSGGTLCTPSRAALGCLVKDYFPEPVTVSWNSGALT SGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 21 |
| 24A | ASTKGPSVFPLAPSSKSTSGGTALCTPSRALGCLVKDYFPEPVTVSWNSGALT SGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 22 |
| 25L | ASTKGPSVFPLAPSSKSTSGGTAALCTPSRLGCLVKDYFPEPVTVSWNSGALT SGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 23 |
| 26G | ASTKGPSVFPLAPSSKSTSGGTAALLCTPSRGCLVKDYFPEPVTVSWNSGALT SGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 24 |

FIG. 15 (Cont.)

| Table 7: CH1 Insertions | | |
|---|---|---|
| Position | Sequence | SEQ ID NO: |
| 36P | ASTKGPSVFPLAPSSKSTSGGTAALGCLVKDYFPELCTPSRPVTVSWNSGALT SGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 25 |
| 41W | ASTKGPSVFPLAPSSKSTSGGTAALGCLVKDYFPEPVTVSLCTPSRWNSGALT SGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 26 |
| 42N | ASTKGPSVFPLAPSSKSTSGGTAALGCLVKDYFPEPVTVSWLCTPSRNSGALT SGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 27 |
| 43S | ASTKGPSVFPLAPSSKSTSGGTAALGCLVKDYFPEPVTVSWNLCTPSRSGALT SGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 28 |
| 44G | ASTKGPSVFPLAPSSKSTSGGTAALGCLVKDYFPEPVTVSWNSLCTPSRGALT SGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 29 |

FIG. 15 (Cont.)

| Table 7: CH1 Insertions | | |
|---|---|---|
| Position | Sequence | SEQ ID NO: |
| 45A | ASTKGPSVFPLAPSSKSTSGGTAALGCLVKDYFPEPVTVSWNSGLCTPSRALT SGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 30 |
| 46L | ASTKGPSVFPLAPSSKSTSGGTAALGCLVKDYFPEPVTVSWNSGALCTPSRLT SGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 31 |
| 47T | ASTKGPSVFPLAPSSKSTSGGTAALGCLVKDYFPEPVTVSWNSGALLCTPSRT SGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 32 |
| 48S | ASTKGPSVFPLAPSSKSTSGGTAALGCLVKDYFPEPVTVSWNSGALTLCTPSR SGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 33 |
| 49G | ASTKGPSVFPLAPSSKSTSGGTAALGCLVKDYFPEPVTVSWNSGALTSLCTPS RGVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 34 |

FIG. 15 (Cont.)

| Table 7: CH1 Insertions | | |
|---|---|---|
| Position | Sequence | SEQ ID NO: |
| 50V | ASTKGPSVFPLAPSSKSTSGGTAALGCLVKDYFPEPVTVSWNSGALTSGLCTP SRVHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 35 |
| 51H | ASTKGPSVFPLAPSSKSTSGGTAALGCLVKDYFPEPVTVSWNSGALTSGVLCT PSRHTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 36 |
| 52T | ASTKGPSVFPLAPSSKSTSGGTAALGCLVKDYFPEPVTVSWNSGALTSGVHLC TPSRTFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 37 |
| 53F | ASTKGPSVFPLAPSSKSTSGGTAALGCLVKDYFPEPVTVSWNSGALTSGVHTL CTPSRFPAVLQSSGLYSLSSVVTVPSSSLGTQTYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 38 |
| 60S | ASTKGPSVFPLAPSSKSTSGGTAALGCLVKDYFPEPVTVSWNSGALTSGVHTF PAVLQSLCTPSRSGLYSLSSVVTVPSSSLGTQTYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 39 |

FIG. 15 (Cont.)

| Table 7: CH1 Insertions | | |
|---|---|---|
| Position | Sequence | SEQ ID NO: |
| 61G | ASTKGPSVFPLAPSSKSTSGGTAALGCLVKDYFPEPVTVSWNSGALTSGVHTF PAVLQSSLCTPSRGLYSLSSVVTVPSSSLGTQTYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 40 |
| 62L | ASTKGPSVFPLAPSSKSTSGGTAALGCLVKDYFPEPVTVSWNSGALTSGVHTF PAVLQSSGLCTPSRLYSLSSVVTVPSSSLGTQTYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 41 |
| 63Y | ASTKGPSVFPLAPSSKSTSGGTAALGCLVKDYFPEPVTVSWNSGALTSGVHTF PAVLQSSGLLCTPSRYSLSSVVTVPSSSLGTQTYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 42 |
| 64S | ASTKGPSVFPLAPSSKSTSGGTAALGCLVKDYFPEPVTVSWNSGALTSGVHTF PAVLQSSGLYLCTPSRSLSSVVTVPSSSLGTQTYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 43 |
| 66S | ASTKGPSVFPLAPSSKSTSGGTAALGCLVKDYFPEPVTVSWNSGALTSGVHTF PAVLQSSGLYSLCTPSRSSVVTVPSSSLGTQTYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 44 |

FIG. 15 (Cont.)

| Table 7: CH1 Insertions | | |
|---|---|---|
| Position | Sequence | SEQ ID NO: |
| 69V | ASTKGPSVFPLAPSSKSTSGGTAALGCLVKDYFPEPVTVSWNSGALTSGVHTF PAVLQSSGLYSLSSVLCTPSRVTVPSSSLGTQTYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 45 |
| 70T | ASTKGPSVFPLAPSSKSTSGGTAALGCLVKDYFPEPVTVSWNSGALTSGVHTF PAVLQSSGLYSLSSVVLCTPSRTVPSSSLGTQTYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 46 |
| 71V | ASTKGPSVFPLAPSSKSTSGGTAALGCLVKDYFPEPVTVSWNSGALTSGVHTF PAVLQSSGLYSLSSVVTLCTPSRVPSSSLGTQTYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 47 |
| 72P | ASTKGPSVFPLAPSSKSTSGGTAALGCLVKDYFPEPVTVSWNSGALTSGVHTF PAVLQSSGLYSLSSVVTVLCTPSRPSSSLGTQTYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 48 |
| 73S | ASTKGPSVFPLAPSSKSTSGGTAALGCLVKDYFPEPVTVSWNSGALTSGVHTF PAVLQSSGLYSLSSVVTVPLCTPSRSSSLGTQTYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 49 |

FIG. 15 (Cont.)

| Table 7: CH1 Insertions | | |
|---|---|---|
| Position | Sequence | SEQ ID NO: |
| 74S | ASTKGPSVFPLAPSSKSTSGGTAALGCLVKDYFPEPVTVSWNSGALTSGVHTF PAVLQSSGLYSLSSVVTVPSLCTPSRSSLGTQTYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 50 |
| 75S | ASTKGPSVFPLAPSSKSTSGGTAALGCLVKDYFPEPVTVSWNSGALTSGVHTF PAVLQSSGLYSLSSVVTVPSSLCTPSRSLGTQTYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 51 |
| 76L | ASTKGPSVFPLAPSSKSTSGGTAALGCLVKDYFPEPVTVSWNSGALTSGVHTF PAVLQSSGLYSLSSVVTVPSSSLCTPSRLGTQTYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 52 |
| 77G | ASTKGPSVFPLAPSSKSTSGGTAALGCLVKDYFPEPVTVSWNSGALTSGVHTF PAVLQSSGLYSLSSVVTVPSSSLLCTPSRGTQTYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 53 |
| 78T | ASTKGPSVFPLAPSSKSTSGGTAALGCLVKDYFPEPVTVSWNSGALTSGVHTF PAVLQSSGLYSLSSVVTVPSSSLGLCTPSRTQTYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 54 |

FIG. 15 (Cont.)

| Position | Sequence | SEQ ID NO: |
|---|---|---|
| Table 7: CH1 Insertions | | |
| 79Q | ASTKGPSVFPLAPSSKSTSGGTAALGCLVKDYFPEPVTVSWNSGALTSGVHTF PAVLQSSGLYSLSSVVTVPSSSLGTLCTPSRQTYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 55 |
| 80T | ASTKGPSVFPLAPSSKSTSGGTAALGCLVKDYFPEPVTVSWNSGALTSGVHTF PAVLQSSGLYSLSSVVTVPSSSLGTQLCTPSRTYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 56 |
| 81Y | ASTKGPSVFPLAPSSKSTSGGTAALGCLVKDYFPEPVTVSWNSGALTSGVHTF PAVLQSSGLYSLSSVVTVPSSSLGTQTLCTPSRYICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 57 |
| 82I | ASTKGPSVFPLAPSSKSTSGGTAALGCLVKDYFPEPVTVSWNSGALTSGVHTF PAVLQSSGLYSLSSVVTVPSSSLGTQTYLCTPSRICNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 58 |
| 83C | ASTKGPSVFPLAPSSKSTSGGTAALGCLVKDYFPEPVTVSWNSGALTSGVHTF PAVLQSSGLYSLSSVVTVPSSSLGTQTYILCTPSRCNVNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 59 |

FIG. 15 (Cont.)

| Table 7: CH1 Insertions | | |
|---|---|---|
| Position | Sequence | SEQ ID NO: |
| 86N | ASTKGPSVFPLAPSSKSTSGGTAALGCLVKDYFPEPVTVSWNSGALTSGVHTF PAVLQSSGLYSLSSVVTVPSSSLGTQTYICNVLCTPSRNHKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 60 |
| 88K | ASTKGPSVFPLAPSSKSTSGGTAALGCLVKDYFPEPVTVSWNSGALTSGVHTF PAVLQSSGLYSLSSVVTVPSSSLGTQTYICNVNHLCTPSRKPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 61 |
| 89P | ASTKGPSVFPLAPSSKSTSGGTAALGCLVKDYFPEPVTVSWNSGALTSGVHTF PAVLQSSGLYSLSSVVTVPSSSLGTQTYICNVNHKLCTPSRPSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 62 |
| 90S | ASTKGPSVFPLAPSSKSTSGGTAALGCLVKDYFPEPVTVSWNSGALTSGVHTF PAVLQSSGLYSLSSVVTVPSSSLGTQTYICNVNHKPLCTPSRSNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 63 |
| 91N | ASTKGPSVFPLAPSSKSTSGGTAALGCLVKDYFPEPVTVSWNSGALTSGVHTF PAVLQSSGLYSLSSVVTVPSSSLGTQTYICNVNHKPSLCTPSRNTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 64 |

FIG. 15 (Cont.)

| Table 7: CH1 Insertions | | |
|---|---|---|
| Position | Sequence | SEQ ID NO: |
| 92T | ASTKGPSVFPLAPSSKSTSGGTAALGCLVKDYFPEPVTVSWNSGALTSGVHTF PAVLQSSGLYSLSSVVTVPSSSLGTQTYICNVNHKPSNLCTPSRTKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 65 |
| 93K | ASTKGPSVFPLAPSSKSTSGGTAALGCLVKDYFPEPVTVSWNSGALTSGVHTF PAVLQSSGLYSLSSVVTVPSSSLGTQTYICNVNHKPSNTLCTPSRKVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 66 |
| 94V | ASTKGPSVFPLAPSSKSTSGGTAALGCLVKDYFPEPVTVSWNSGALTSGVHTF PAVLQSSGLYSLSSVVTVPSSSLGTQTYICNVNHKPSNTKLCTPSRVDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 67 |
| 95D | ASTKGPSVFPLAPSSKSTSGGTAALGCLVKDYFPEPVTVSWNSGALTSGVHTF PAVLQSSGLYSLSSVVTVPSSSLGTQTYICNVNHKPSNTKVLCTPSRDKKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 68 |
| 97K | ASTKGPSVFPLAPSSKSTSGGTAALGCLVKDYFPEPVTVSWNSGALTSGVHTF PAVLQSSGLYSLSSVVTVPSSSLGTQTYICNVNHKPSNTKVDKLCTPSRKVEP KSCDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKCKV SNKALPAPIEKTISKAKGQPREPQVYTLPPSREEMTKNQVSLTCLVKGFYPSD IAVEWESNGQPENNYKTTPPVLDSDGSFFLYSKLTVDKSRWQQGNVFSCSVMH EALHNHYTQKSLSLSPGK | 69 |

FIG. 16

| | Table 8: Hinge Insertions | |
|---|---|---|
| Position | Sequence | SEQ ID NO |
| 100P | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVELCT PSRPKSCDKTHTCPPCPAPELLGGPSVFLFPPKPKDTLMISRTPEVTCVVV DVSHEDPEVKFNWYVDGVEVHNAKTKPREEQYNSTYRVVSVLTVLHQDWLN GKEYKCKVSNKALPAPIEKTISKAKGQPREPQVYTLPPSREEMTKNQVSLT CLVKGFYPSDIAVEWESNGQPENNYKTTPPVLDSDGSFFLYSKLTVDKSRW QQGNVFSCSVMHEALHNHYTQKSLSLSPGK | 70 |
| 101K | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPLC TPSRKSCDKTHTCPPCPAPELLGGPSVFLFPPKPKDTLMISRTPEVTCVVV DVSHEDPEVKFNWYVDGVEVHNAKTKPREEQYNSTYRVVSVLTVLHQDWLN GKEYKCKVSNKALPAPIEKTISKAKGQPREPQVYTLPPSREEMTKNQVSLT CLVKGFYPSDIAVEWESNGQPENNYKTTPPVLDSDGSFFLYSKLTVDKSRW QQGNVFSCSVMHEALHNHYTQKSLSLSPGK | 71 |
| 102S | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKL CTPSRSCDKTHTCPPCPAPELLGGPSVFLFPPKPKDTLMISRTPEVTCVVV DVSHEDPEVKFNWYVDGVEVHNAKTKPREEQYNSTYRVVSVLTVLHQDWLN GKEYKCKVSNKALPAPIEKTISKAKGQPREPQVYTLPPSREEMTKNQVSLT CLVKGFYPSDIAVEWESNGQPENNYKTTPPVLDSDGSFFLYSKLTVDKSRW QQGNVFSCSVMHEALHNHYTQKSLSLSPGK | 72 |
| 103C | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS LCTPSRCDKTHTCPPCPAPELLGGPSVFLFPPKPKDTLMISRTPEVTCVVV DVSHEDPEVKFNWYVDGVEVHNAKTKPREEQYNSTYRVVSVLTVLHQDWLN GKEYKCKVSNKALPAPIEKTISKAKGQPREPQVYTLPPSREEMTKNQVSLT CLVKGFYPSDIAVEWESNGQPENNYKTTPPVLDSDGSFFLYSKLTVDKSRW QQGNVFSCSVMHEALHNHYTQKSLSLSPGK | 73 |
| 104D | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CLCTPSRDKTHTCPPCPAPELLGGPSVFLFPPKPKDTLMISRTPEVTCVVV DVSHEDPEVKFNWYVDGVEVHNAKTKPREEQYNSTYRVVSVLTVLHQDWLN GKEYKCKVSNKALPAPIEKTISKAKGQPREPQVYTLPPSREEMTKNQVSLT CLVKGFYPSDIAVEWESNGQPENNYKTTPPVLDSDGSFFLYSKLTVDKSRW QQGNVFSCSVMHEALHNHYTQKSLSLSPGK | 74 |

FIG. 16 (Cont.)

| Table 8: Hinge Insertions | | |
|---|---|---|
| Position | Sequence | SEQ ID NO |
| 105K | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDLCTPSRKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK | 75 |
| 106T | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKLCTPSRTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK | 76 |
| 107H | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTLCTPSRHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK | 77 |
| 108T | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHLCTPSRTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK | 78 |
| 109C | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTLCTPSRCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK | 79 |

FIG. 16 (Cont.)

| \multicolumn{3}{|c|}{Table 8: Hinge Insertions} |||
|---|---|---|
| Position | Sequence | SEQ ID NO |
| 110P | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCLCTPSRPPCPAPELLGGPSVFLFPPKPKDTLMISRTPEVTCVVV DVSHEDPEVKFNWYVDGVEVHNAKTKPREEQYNSTYRVVSVLTVLHQDWLN GKEYKCKVSNKALPAPIEKTISKAKGQPREPQVYTLPPSREEMTKNQVSLT CLVKGFYPSDIAVEWESNGQPENNYKTTPPVLDSDGSFFLYSKLTVDKSRW QQGNVFSCSVMHEALHNHYTQKSLSLSPGK | 80 |
| 112C | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPLCTPSRCPAPELLGGPSVFLFPPKPKDTLMISRTPEVTCVVV DVSHEDPEVKFNWYVDGVEVHNAKTKPREEQYNSTYRVVSVLTVLHQDWLN GKEYKCKVSNKALPAPIEKTISKAKGQPREPQVYTLPPSREEMTKNQVSLT CLVKGFYPSDIAVEWESNGQPENNYKTTPPVLDSDGSFFLYSKLTVDKSRW QQGNVFSCSVMHEALHNHYTQKSLSLSPGK | 81 |
| 113P | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCLCTPSRPAPELLGGPSVFLFPPKPKDTLMISRTPEVTCVVV DVSHEDPEVKFNWYVDGVEVHNAKTKPREEQYNSTYRVVSVLTVLHQDWLN GKEYKCKVSNKALPAPIEKTISKAKGQPREPQVYTLPPSREEMTKNQVSLT CLVKGFYPSDIAVEWESNGQPENNYKTTPPVLDSDGSFFLYSKLTVDKSRW QQGNVFSCSVMHEALHNHYTQKSLSLSPGK | 82 |

FIG. 17

| Table 9: CH2 Insertions |||
|---|---|---|
| Position | Sequence | SEQ ID NO: |
| 114A | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPLCTPSRAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK | 83 |
| 115P | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPALCTPSRPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK | 84 |
| 116E | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPLCTPSRELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK | 85 |
| 118L | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLCTPSRLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK | 86 |
| 119G | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLLCTPSRGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK | 87 |

FIG. 17 (Cont.)

| Table 9: CH2 Insertions | | |
|---|---|---|
| Position | Sequence | SEQ ID NO: |
| 121P | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGLCTPSRPSVFLFPPKPKDTLMISRTPEVTCVVV DVSHEDPEVKFNWYVDGVEVHNAKTKPREEQYNSTYRVVSVLTVLHQDWLN GKEYKCKVSNKALPAPIEKTISKAKGQPREPQVYTLPPSREEMTKNQVSLT CLVKGFYPSDIAVEWESNGQPENNYKTTPPVLDSDGSFFLYSKLTVDKSRW QQGNVFSCSVMHEALHNHYTQKSLSLSPGK | 88 |
| 122S | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPLCTPSRSVFLFPPKPKDTLMISRTPEVTCVVV DVSHEDPEVKFNWYVDGVEVHNAKTKPREEQYNSTYRVVSVLTVLHQDWLN GKEYKCKVSNKALPAPIEKTISKAKGQPREPQVYTLPPSREEMTKNQVSLT CLVKGFYPSDIAVEWESNGQPENNYKTTPPVLDSDGSFFLYSKLTVDKSRW QQGNVFSCSVMHEALHNHYTQKSLSLSPGK | 89 |
| 138R | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISLCTPSRRTPEVTCVVV DVSHEDPEVKFNWYVDGVEVHNAKTKPREEQYNSTYRVVSVLTVLHQDWLN GKEYKCKVSNKALPAPIEKTISKAKGQPREPQVYTLPPSREEMTKNQVSLT CLVKGFYPSDIAVEWESNGQPENNYKTTPPVLDSDGSFFLYSKLTVDKSRW QQGNVFSCSVMHEALHNHYTQKSLSLSPGK | 90 |
| 139T | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRLCTPSRTPEVTCVVV DVSHEDPEVKFNWYVDGVEVHNAKTKPREEQYNSTYRVVSVLTVLHQDWLN GKEYKCKVSNKALPAPIEKTISKAKGQPREPQVYTLPPSREEMTKNQVSLT CLVKGFYPSDIAVEWESNGQPENNYKTTPPVLDSDGSFFLYSKLTVDKSRW QQGNVFSCSVMHEALHNHYTQKSLSLSPGK | 91 |
| 140P | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTLCTPSRPEVTCVVV DVSHEDPEVKFNWYVDGVEVHNAKTKPREEQYNSTYRVVSVLTVLHQDWLN GKEYKCKVSNKALPAPIEKTISKAKGQPREPQVYTLPPSREEMTKNQVSLT CLVKGFYPSDIAVEWESNGQPENNYKTTPPVLDSDGSFFLYSKLTVDKSRW QQGNVFSCSVMHEALHNHYTQKSLSLSPGK | 92 |

FIG. 17 (Cont.)

| Table 9: CH2 Insertions ||| 
|---|---|---|
| Position | Sequence | SEQ ID NO: |
| 150S | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVLCTP SRSHEDPEVKFNWYVDGVEVHNAKTKPREEQYNSTYRVVSVLTVLHQDWLN GKEYKCKVSNKALPAPIEKTISKAKGQPREPQVYTLPPSREEMTKNQVSLT CLVKGFYPSDIAVEWESNGQPENNYKTTPPVLDSDGSFFLYSKLTVDKSRW QQGNVFSCSVMHEALHNHYTQKSLSLSPGK | 93 |
| 151H | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSLCT PSRHEDPEVKFNWYVDGVEVHNAKTKPREEQYNSTYRVVSVLTVLHQDWLN GKEYKCKVSNKALPAPIEKTISKAKGQPREPQVYTLPPSREEMTKNQVSLT CLVKGFYPSDIAVEWESNGQPENNYKTTPPVLDSDGSFFLYSKLTVDKSRW QQGNVFSCSVMHEALHNHYTQKSLSLSPGK | 94 |
| 152E | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHLC TPSREDPEVKFNWYVDGVEVHNAKTKPREEQYNSTYRVVSVLTVLHQDWLN GKEYKCKVSNKALPAPIEKTISKAKGQPREPQVYTLPPSREEMTKNQVSLT CLVKGFYPSDIAVEWESNGQPENNYKTTPPVLDSDGSFFLYSKLTVDKSRW QQGNVFSCSVMHEALHNHYTQKSLSLSPGK | 95 |
| 153D | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHEL CTPSRDPEVKFNWYVDGVEVHNAKTKPREEQYNSTYRVVSVLTVLHQDWLN GKEYKCKVSNKALPAPIEKTISKAKGQPREPQVYTLPPSREEMTKNQVSLT CLVKGFYPSDIAVEWESNGQPENNYKTTPPVLDSDGSFFLYSKLTVDKSRW QQGNVFSCSVMHEALHNHYTQKSLSLSPGK | 96 |
| 154P | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED LCTPSRPEVKFNWYVDGVEVHNAKTKPREEQYNSTYRVVSVLTVLHQDWLN GKEYKCKVSNKALPAPIEKTISKAKGQPREPQVYTLPPSREEMTKNQVSLT CLVKGFYPSDIAVEWESNGQPENNYKTTPPVLDSDGSFFLYSKLTVDKSRW QQGNVFSCSVMHEALHNHYTQKSLSLSPGK | 97 |

FIG. 17 (Cont.)

| | Table 9: CH2 Insertions | |
|---|---|---|
| Position | Sequence | SEQ ID NO: |
| 155E | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PLCTPSREVKFNWYVDGVEVHNAKTKPREEQYNSTYRVVSVLTVLHQDWLN GKEYKCKVSNKALPAPIEKTISKAKGQPREPQVYTLPPSREEMTKNQVSLT CLVKGFYPSDIAVEWESNGQPENNYKTTPPVLDSDGSFFLYSKLTVDKSRW QQGNVFSCSVMHEALHNHYTQKSLSLSPGK | 98 |
| 158F | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKLCTPSRFNWYVDGVEVHNAKTKPREEQYNSTYRVVSVLTVLHQDWLN GKEYKCKVSNKALPAPIEKTISKAKGQPREPQVYTLPPSREEMTKNQVSLT CLVKGFYPSDIAVEWESNGQPENNYKTTPPVLDSDGSFFLYSKLTVDKSRW QQGNVFSCSVMHEALHNHYTQKSLSLSPGK | 99 |
| 167V | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVELCTPSRVHNAKTKPREEQYNSTYRVVSVLTVLHQDWLN GKEYKCKVSNKALPAPIEKTISKAKGQPREPQVYTLPPSREEMTKNQVSLT CLVKGFYPSDIAVEWESNGQPENNYKTTPPVLDSDGSFFLYSKLTVDKSRW QQGNVFSCSVMHEALHNHYTQKSLSLSPGK | 100 |
| 168H | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVEVLCTPSRHNAKTKPREEQYNSTYRVVSVLTVLHQDWLN GKEYKCKVSNKALPAPIEKTISKAKGQPREPQVYTLPPSREEMTKNQVSLT CLVKGFYPSDIAVEWESNGQPENNYKTTPPVLDSDGSFFLYSKLTVDKSRW QQGNVFSCSVMHEALHNHYTQKSLSLSPGK | 101 |
| 169N | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVEVHLCTPSRNAKTKPREEQYNSTYRVVSVLTVLHQDWLN GKEYKCKVSNKALPAPIEKTISKAKGQPREPQVYTLPPSREEMTKNQVSLT CLVKGFYPSDIAVEWESNGQPENNYKTTPPVLDSDGSFFLYSKLTVDKSRW QQGNVFSCSVMHEALHNHYTQKSLSLSPGK | 102 |

FIG. 17 (Cont.)

| Table 9: CH2 Insertions | | |
|---|---|---|
| Position | Sequence | SEQ ID NO: |
| 170A | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVEVHNLCTPSRAKTKPREEQYNSTYRVVSVLTVLHQDWLN GKEYKCKVSNKALPAPIEKTISKAKGQPREPQVYTLPPSREEMTKNQVSLT CLVKGFYPSDIAVEWESNGQPENNYKTTPPVLDSDGSFFLYSKLTVDKSRW QQGNVFSCSVMHEALHNHYTQKSLSLSPGK | 103 |
| 171K | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVEVHNALCTPSRKTKPREEQYNSTYRVVSVLTVLHQDWLN GKEYKCKVSNKALPAPIEKTISKAKGQPREPQVYTLPPSREEMTKNQVSLT CLVKGFYPSDIAVEWESNGQPENNYKTTPPVLDSDGSFFLYSKLTVDKSRW QQGNVFSCSVMHEALHNHYTQKSLSLSPGK | 104 |
| 172T | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVEVHNAKLCTPSRTKPREEQYNSTYRVVSVLTVLHQDWLN GKEYKCKVSNKALPAPIEKTISKAKGQPREPQVYTLPPSREEMTKNQVSLT CLVKGFYPSDIAVEWESNGQPENNYKTTPPVLDSDGSFFLYSKLTVDKSRW QQGNVFSCSVMHEALHNHYTQKSLSLSPGK | 105 |
| 179Y | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVEVHNAKTKPREEQLCTPSRYNSTYRVVSVLTVLHQDWLN GKEYKCKVSNKALPAPIEKTISKAKGQPREPQVYTLPPSREEMTKNQVSLT CLVKGFYPSDIAVEWESNGQPENNYKTTPPVLDSDGSFFLYSKLTVDKSRW QQGNVFSCSVMHEALHNHYTQKSLSLSPGK | 106 |
| 183Y | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVEVHNAKTKPREEQYNSTLCTPSRYRVVSVLTVLHQDWLN GKEYKCKVSNKALPAPIEKTISKAKGQPREPQVYTLPPSREEMTKNQVSLT CLVKGFYPSDIAVEWESNGQPENNYKTTPPVLDSDGSFFLYSKLTVDKSRW QQGNVFSCSVMHEALHNHYTQKSLSLSPGK | 107 |

FIG. 17 (Cont.)

| Table 9: CH2 Insertions | | |
|---|---|---|
| Position | Sequence | SEQ ID NO: |
| 184R | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVEVHNAKTKPREEQYNSTYLCTPSRRVVSVLTVLHQDWLN GKEYKCKVSNKALPAPIEKTISKAKGQPREPQVYTLPPSREEMTKNQVSLT CLVKGFYPSDIAVEWESNGQPENNYKTTPPVLDSDGSFFLYSKLTVDKSRW QQGNVFSCSVMHEALHNHYTQKSLSLSPGK | 108 |
| 185V | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVEVHNAKTKPREEQYNSTYRLCTPSRVVSVLTVLHQDWLN GKEYKCKVSNKALPAPIEKTISKAKGQPREPQVYTLPPSREEMTKNQVSLT CLVKGFYPSDIAVEWESNGQPENNYKTTPPVLDSDGSFFLYSKLTVDKSRW QQGNVFSCSVMHEALHNHYTQKSLSLSPGK | 109 |
| 186V | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVEVHNAKTKPREEQYNSTYRVLCTPSRVSVLTVLHQDWLN GKEYKCKVSNKALPAPIEKTISKAKGQPREPQVYTLPPSREEMTKNQVSLT CLVKGFYPSDIAVEWESNGQPENNYKTTPPVLDSDGSFFLYSKLTVDKSRW QQGNVFSCSVMHEALHNHYTQKSLSLSPGK | 110 |
| 187S | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVEVHNAKTKPREEQYNSTYRVVLCTPSRSVLTVLHQDWLN GKEYKCKVSNKALPAPIEKTISKAKGQPREPQVYTLPPSREEMTKNQVSLT CLVKGFYPSDIAVEWESNGQPENNYKTTPPVLDSDGSFFLYSKLTVDKSRW QQGNVFSCSVMHEALHNHYTQKSLSLSPGK | 111 |
| 209K | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKC KVSNLCTPSRKALPAPIEKTISKAKGQPREPQVYTLPPSREEMTKNQVSLT CLVKGFYPSDIAVEWESNGQPENNYKTTPPVLDSDGSFFLYSKLTVDKSRW QQGNVFSCSVMHEALHNHYTQKSLSLSPGK | 112 |

FIG. 17 (Cont.)

| Table 9: CH2 Insertions ||||
|---|---|---|
| Position | Sequence | SEQ ID NO: |
| 210A | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKC KVSNKLCTPSRALPAPIEKTISKAKGQPREPQVYTLPPSREEMTKNQVSLT CLVKGFYPSDIAVEWESNGQPENNYKTTPPVLDSDGSFFLYSKLTVDKSRW QQGNVFSCSVMHEALHNHYTQKSLSLSPGK | 113 |
| 211L | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKC KVSNKALCTPSRLPAPIEKTISKAKGQPREPQVYTLPPSREEMTKNQVSLT CLVKGFYPSDIAVEWESNGQPENNYKTTPPVLDSDGSFFLYSKLTVDKSRW QQGNVFSCSVMHEALHNHYTQKSLSLSPGK | 114 |
| 213A | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKC KVSNKALPLCTPSRAPIEKTISKAKGQPREPQVYTLPPSREEMTKNQVSLT CLVKGFYPSDIAVEWESNGQPENNYKTTPPVLDSDGSFFLYSKLTVDKSRW QQGNVFSCSVMHEALHNHYTQKSLSLSPGK | 115 |
| 214P | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKC KVSNKALPALCTPSRPIEKTISKAKGQPREPQVYTLPPSREEMTKNQVSLT CLVKGFYPSDIAVEWESNGQPENNYKTTPPVLDSDGSFFLYSKLTVDKSRW QQGNVFSCSVMHEALHNHYTQKSLSLSPGK | 116 |
| 215I | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKC KVSNKALPAPLCTPSRIEKTISKAKGQPREPQVYTLPPSREEMTKNQVSLT CLVKGFYPSDIAVEWESNGQPENNYKTTPPVLDSDGSFFLYSKLTVDKSRW QQGNVFSCSVMHEALHNHYTQKSLSLSPGK | 117 |

FIG. 17 (Cont.)

| Table 9: CH2 Insertions | | |
|---|---|---|
| Position | Sequence | SEQ ID NO: |
| 221K | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISLCTPSRKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK | 118 |
| 222A | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKLCTPSRAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK | 119 |

FIG. 18

| Table 10: CH3 Insertions | | |
|---|---|---|
| Position | Sequence | SEQ ID NO: |
| 224G | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLPPKPKDTLMISRTPEVTCVVVDVSHED PEVKFNWYVDGVEVHNAKTKPREEQYNSTYRVVSVLTVLHQDWLNGKEYKC KVSNKALPAPIEKTISKAKLCTPSRGQPREPQVYTLPPSREEMTKNQVSLT CLVKGFYPSDIAVEWESNGQPENNYKTTPPVLDSDGSFFLYSKLTVDKSRW QQGNVFSCSVMHEALHNHYTQKSLSLSPGK | 120 |
| 225Q | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLPPKPKDTLMISRTPEVTCVVVDVSHED PEVKFNWYVDGVEVHNAKTKPREEQYNSTYRVVSVLTVLHQDWLNGKEYKC KVSNKALPAPIEKTISKAKGLCTPSRQPREPQVYTLPPSREEMTKNQVSLT CLVKGFYPSDIAVEWESNGQPENNYKTTPPVLDSDGSFFLYSKLTVDKSRW QQGNVFSCSVMHEALHNHYTQKSLSLSPGK | 121 |
| 227R | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLPPKPKDTLMISRTPEVTCVVVDVSHED PEVKFNWYVDGVEVHNAKTKPREEQYNSTYRVVSVLTVLHQDWLNGKEYKC KVSNKALPAPIEKTISKAKGQPLCTPSRREPQVYTLPPSREEMTKNQVSLT CLVKGFYPSDIAVEWESNGQPENNYKTTPPVLDSDGSFFLYSKLTVDKSRW QQGNVFSCSVMHEALHNHYTQKSLSLSPGK | 122 |
| 228E | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLPPKPKDTLMISRTPEVTCVVVDVSHED PEVKFNWYVDGVEVHNAKTKPREEQYNSTYRVVSVLTVLHQDWLNGKEYKC KVSNKALPAPIEKTISKAKGQPRLCTPSREPQVYTLPPSREEMTKNQVSLT CLVKGFYPSDIAVEWESNGQPENNYKTTPPVLDSDGSFFLYSKLTVDKSRW QQGNVFSCSVMHEALHNHYTQKSLSLSPGK | 123 |
| 230Q | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLPPKPKDTLMISRTPEVTCVVVDVSHED PEVKFNWYVDGVEVHNAKTKPREEQYNSTYRVVSVLTVLHQDWLNGKEYKC KVSNKALPAPIEKTISKAKGQPREPLCTPSRQVYTLPPSREEMTKNQVSLT CLVKGFYPSDIAVEWESNGQPENNYKTTPPVLDSDGSFFLYSKLTVDKSRW QQGNVFSCSVMHEALHNHYTQKSLSLSPGK | 124 |

FIG. 18 (Cont.)

| Table 10: CH3 Insertions | | |
|---|---|---|
| Position | Sequence | SEQ ID NO: |
| 235P | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKC KVSNKALPAPIEKTISKAKGQPREPQVYTLLCTPSRPPSREEMTKNQVSLT CLVKGFYPSDIAVEWESNGQPENNYKTTPPVLDSDGSFFLYSKLTVDKSRW QQGNVFSCSVMHEALHNHYTQKSLSLSPGK | 125 |
| 236P | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKC KVSNKALPAPIEKTISKAKGQPREPQVYTLPLCTPSRPSREEMTKNQVSLT CLVKGFYPSDIAVEWESNGQPENNYKTTPPVLDSDGSFFLYSKLTVDKSRW QQGNVFSCSVMHEALHNHYTQKSLSLSPGK | 126 |
| 237S | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKC KVSNKALPAPIEKTISKAKGQPREPQVYTLPPLCTPSRSREEMTKNQVSLT CLVKGFYPSDIAVEWESNGQPENNYKTTPPVLDSDGSFFLYSKLTVDKSRW QQGNVFSCSVMHEALHNHYTQKSLSLSPGK | 127 |
| 238R | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKC KVSNKALPAPIEKTISKAKGQPREPQVYTLPPSLCTPSRREEMTKNQVSLT CLVKGFYPSDIAVEWESNGQPENNYKTTPPVLDSDGSFFLYSKLTVDKSRW QQGNVFSCSVMHEALHNHYTQKSLSLSPGK | 128 |
| 239E | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKC KVSNKALPAPIEKTISKAKGQPREPQVYTLPPSRLCTPSREEMTKNQVSLT CLVKGFYPSDIAVEWESNGQPENNYKTTPPVLDSDGSFFLYSKLTVDKSRW QQGNVFSCSVMHEALHNHYTQKSLSLSPGK | 129 |

FIG. 18 (Cont.)

| \multicolumn{3}{|c|}{Table 10: CH3 Insertions} |||
|---|---|---|
| Position | Sequence | SEQ ID NO: |
| 240E | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKC KVSNKALPAPIEKTISKAKGQPREPQVYTLPPSRELCTPSREMTKNQVSLT CLVKGFYPSDIAVEWESNGQPENNYKTTPPVLDSDGSFFLYSKLTVDKSRW QQGNVFSCSVMHEALHNHYTQKSLSLSPGK | 130 |
| 241M | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKC KVSNKALPAPIEKTISKAKGQPREPQVYTLPPSREELCTPSRMTKNQVSLT CLVKGFYPSDIAVEWESNGQPENNYKTTPPVLDSDGSFFLYSKLTVDKSRW QQGNVFSCSVMHEALHNHYTQKSLSLSPGK | 131 |
| 243K | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKC KVSNKALPAPIEKTISKAKGQPREPQVYTLPPSREEMTLCTPSRKNQVSLT CLVKGFYPSDIAVEWESNGQPENNYKTTPPVLDSDGSFFLYSKLTVDKSRW QQGNVFSCSVMHEALHNHYTQKSLSLSPGK | 132 |
| 244N | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKC KVSNKALPAPIEKTISKAKGQPREPQVYTLPPSREEMTKLCTPSRNQVSLT CLVKGFYPSDIAVEWESNGQPENNYKTTPPVLDSDGSFFLYSKLTVDKSRW QQGNVFSCSVMHEALHNHYTQKSLSLSPGK | 133 |
| 246V | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKC KVSNKALPAPIEKTISKAKGQPREPQVYTLPPSREEMTKNQLCTPSRVSLT CLVKGFYPSDIAVEWESNGQPENNYKTTPPVLDSDGSFFLYSKLTVDKSRW QQGNVFSCSVMHEALHNHYTQKSLSLSPGK | 134 |

FIG. 18 (Cont.)

| Table 10: CH3 Insertions | | |
|---|---|---|
| Position | Sequence | SEQ ID NO: |
| 247S | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKC KVSNKALPAPIEKTISKAKGQPREPQVYTLPPSREEMTKNQVLCTPSRSLT CLVKGFYPSDIAVEWESNGQPENNYKTTPPVLDSDGSFFLYSKLTVDKSRW QQGNVFSCSVMHEALHNHYTQKSLSLSPGK | 135 |
| 254G | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKC KVSNKALPAPIEKTISKAKGQPREPQVYTLPPSREEMTKNQVSLTCLVKLC TPSRGFYPSDIAVEWESNGQPENNYKTTPPVLDSDGSFFLYSKLTVDKSRW QQGNVFSCSVMHEALHNHYTQKSLSLSPGK | 136 |
| 257P | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKC KVSNKALPAPIEKTISKAKGQPREPQVYTLPPSREEMTKNQVSLTCLVKGF YLCTPSRPSDIAVEWESNGQPENNYKTTPPVLDSDGSFFLYSKLTVDKSRW QQGNVFSCSVMHEALHNHYTQKSLSLSPGK | 137 |
| 264W | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKC KVSNKALPAPIEKTISKAKGQPREPQVYTLPPSREEMTKNQVSLTCLVKGF YPSDIAVELCTPSRWESNGQPENNYKTTPPVLDSDGSFFLYSKLTVDKSRW QQGNVFSCSVMHEALHNHYTQKSLSLSPGK | 138 |
| 267N | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKC KVSNKALPAPIEKTISKAKGQPREPQVYTLPPSREEMTKNQVSLTCLVKGF YPSDIAVEWESLCTPSRNGQPENNYKTTPPVLDSDGSFFLYSKLTVDKSRW QQGNVFSCSVMHEALHNHYTQKSLSLSPGK | 139 |

FIG. 18 (Cont.)

| Table 10: CH3 Insertions | | |
|---|---|---|
| Position | Sequence | SEQ ID NO: |
| 268G | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKC KVSNKALPAPIEKTISKAKGQPREPQVYTLPPSREEMTKNQVSLTCLVKGF YPSDIAVEWESNLCTPSRGQPENNYKTTPPVLDSDGSFFLYSKLTVDKSRW QQGNVFSCSVMHEALHNHYTQKSLSLSPGK | 140 |
| 269Q | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKC KVSNKALPAPIEKTISKAKGQPREPQVYTLPPSREEMTKNQVSLTCLVKGF YPSDIAVEWESNGLCTPSRQPENNYKTTPPVLDSDGSFFLYSKLTVDKSRW QQGNVFSCSVMHEALHNHYTQKSLSLSPGK | 141 |
| 270P | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKC KVSNKALPAPIEKTISKAKGQPREPQVYTLPPSREEMTKNQVSLTCLVKGF YPSDIAVEWESNGQLCTPSRPENNYKTTPPVLDSDGSFFLYSKLTVDKSRW QQGNVFSCSVMHEALHNHYTQKSLSLSPGK | 142 |
| 271E | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKC KVSNKALPAPIEKTISKAKGQPREPQVYTLPPSREEMTKNQVSLTCLVKGF YPSDIAVEWESNGQPLCTPSRENNYKTTPPVLDSDGSFFLYSKLTVDKSRW QQGNVFSCSVMHEALHNHYTQKSLSLSPGK | 143 |
| 272N | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKC KVSNKALPAPIEKTISKAKGQPREPQVYTLPPSREEMTKNQVSLTCLVKGF YPSDIAVEWESNGQPELCTPSRNNYKTTPPVLDSDGSFFLYSKLTVDKSRW QQGNVFSCSVMHEALHNHYTQKSLSLSPGK | 144 |

FIG. 18 (Cont.)

| Table 10: CH3 Insertions | | |
|---|---|---|
| Position | Sequence | SEQ ID NO: |
| 268G | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNLCTPSRGQPENNYKTTPPVLDSDGSFFLYSKLTVDKSRWQQGNVFSCSVMHEALHNHYTQKSLSLSPGK | 140 |
| 269Q | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGLCTPSRQPENNYKTTPPVLDSDGSFFLYSKLTVDKSRWQQGNVFSCSVMHEALHNHYTQKSLSLSPGK | 141 |
| 270P | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQLCTPSRPENNYKTTPPVLDSDGSFFLYSKLTVDKSRWQQGNVFSCSVMHEALHNHYTQKSLSLSPGK | 142 |
| 271E | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPLCTPSRENNYKTTPPVLDSDGSFFLYSKLTVDKSRWQQGNVFSCSVMHEALHNHYTQKSLSLSPGK | 143 |
| 272N | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPELCTPSRNNYKTTPPVLDSDGSFFLYSKLTVDKSRWQQGNVFSCSVMHEALHNHYTQKSLSLSPGK | 144 |

FIG. 18 (Cont.)

| \multicolumn{3}{c}{Table 10: CH3 Insertions} |

| Position | Sequence | SEQ ID NO: |
|---|---|---|
| 273N | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKC KVSNKALPAPIEKTISKAKGQPREPQVYTLPPSREEMTKNQVSLTCLVKGF YPSDIAVEWESNGQPENLCTPSRNYKTTPPVLDSDGSFFLYSKLTVDKSRW QQGNVFSCSVMHEALHNHYTQKSLSLSPGK | 145 |
| 274Y | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKC KVSNKALPAPIEKTISKAKGQPREPQVYTLPPSREEMTKNQVSLTCLVKGF YPSDIAVEWESNGQPENNLCTPSRYKTTPPVLDSDGSFFLYSKLTVDKSRW QQGNVFSCSVMHEALHNHYTQKSLSLSPGK | 146 |
| 275K | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKC KVSNKALPAPIEKTISKAKGQPREPQVYTLPPSREEMTKNQVSLTCLVKGF YPSDIAVEWESNGQPENNYLCTPSRKTTPPVLDSDGSFFLYSKLTVDKSRW QQGNVFSCSVMHEALHNHYTQKSLSLSPGK | 147 |
| 276T | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKC KVSNKALPAPIEKTISKAKGQPREPQVYTLPPSREEMTKNQVSLTCLVKGF YPSDIAVEWESNGQPENNYKLCTPSRTTPPVLDSDGSFFLYSKLTVDKSRW QQGNVFSCSVMHEALHNHYTQKSLSLSPGK | 148 |
| 277T | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKC KVSNKALPAPIEKTISKAKGQPREPQVYTLPPSREEMTKNQVSLTCLVKGF YPSDIAVEWESNGQPENNYKTLCTPSRTPPVLDSDGSFFLYSKLTVDKSRW QQGNVFSCSVMHEALHNHYTQKSLSLSPGK | 149 |

FIG. 18 (Cont.)

| Table 10: CH3 Insertions | | |
|---|---|---|
| Position | Sequence | SEQ ID NO: |
| 279P | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPLCTPSRPVLDSDGSFFLYSKLTVDKSRWQQGNVFSCSVMHEALHNHYTQKSLSLSPGK | 150 |
| 283S | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDLCTPSRDGSFFLYSKLTVDKSRWQQGNVFSCSVMHEALHNHYTQKSLSLSPGK | 151 |
| 284D | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSLCTPSRDGSFFLYSKLTVDKSRWQQGNVFSCSVMHEALHNHYTQKSLSLSPGK | 152 |
| 285G | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDLCTPSRGSFFLYSKLTVDKSRWQQGNVFSCSVMHEALHNHYTQKSLSLSPGK | 153 |
| 286S | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGLCTPSRSFFLYSKLTVDKSRWQQGNVFSCSVMHEALHNHYTQKSLSLSPGK | 154 |

FIG. 18 (Cont.)

| Table 10: CH3 Insertions | | |
|---|---|---|
| Position | Sequence | SEQ ID NO: |
| 287F | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSLCTPSRFFLYSKLTVDKSRWQQGNVFSCSVMHEALHNHYTQKSLSLSPGK | 155 |
| 288F | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLCTPSRFLYSKLTVDKSRWQQGNVFSCSVMHEALHNHYTQKSLSLSPGK | 156 |
| 295V | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTLCTPSRVDKSRWQQGNVFSCSVMHEALHNHYTQKSLSLSPGK | 157 |
| 296D | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVLCTPSRDKSRWQQGNVFSCSVMHEALHNHYTQKSLSLSPGK | 158 |
| 297K | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDLCTPSRKSRWQQGNVFSCSVMHEALHNHYTQKSLSLSPGK | 159 |

FIG. 18 (Cont.)

| Table 10: CH3 Insertions ||| 
|---|---|---|
| Position | Sequence | SEQ ID NO: |
| 298S | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKC KVSNKALPAPIEKTISKAKGQPREPQVYTLPPSREEMTKNQVSLTCLVKGF YPSDIAVEWESNGQPENNYKTTPPVLDSDGSFFLYSKLTVDKLCTPSRSRW QQGNVFSCSVMHEALHNHYTQKSLSLSPGK | 160 |
| 299R | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKC KVSNKALPAPIEKTISKAKGQPREPQVYTLPPSREEMTKNQVSLTCLVKGF YPSDIAVEWESNGQPENNYKTTPPVLDSDGSFFLYSKLTVDKSLCTPSRRW QQGNVFSCSVMHEALHNHYTQKSLSLSPGK | 161 |
| 300W | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKC KVSNKALPAPIEKTISKAKGQPREPQVYTLPPSREEMTKNQVSLTCLVKGF YPSDIAVEWESNGQPENNYKTTPPVLDSDGSFFLYSKLTVDKSRLCTPSRW QQGNVFSCSVMHEALHNHYTQKSLSLSPGK | 162 |
| 301Q | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKC KVSNKALPAPIEKTISKAKGQPREPQVYTLPPSREEMTKNQVSLTCLVKGF YPSDIAVEWESNGQPENNYKTTPPVLDSDGSFFLYSKLTVDKSRWLCTPSR QQGNVFSCSVMHEALHNHYTQKSLSLSPGK | 163 |
| 302Q | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKC KVSNKALPAPIEKTISKAKGQPREPQVYTLPPSREEMTKNQVSLTCLVKGF YPSDIAVEWESNGQPENNYKTTPPVLDSDGSFFLYSKLTVDKSRWQLCTPS RQGNVFSCSVMHEALHNHYTQKSLSLSPGK | 164 |

FIG. 18 (Cont.)

| Table 10: CH3 Insertions ||||
|---|---|---|
| Position | Sequence | SEQ ID NO: |
| 303G | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKC KVSNKALPAPIEKTISKAKGQPREPQVYTLPPSREEMTKNQVSLTCLVKGF YPSDIAVEWESNGQPENNYKTTPPVLDSDGSFFLYSKLTVDKSRWQQLCTP SRGNVFSCSVMHEALHNHYTQKSLSLSPGK | 165 |
| 304N | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKC KVSNKALPAPIEKTISKAKGQPREPQVYTLPPSREEMTKNQVSLTCLVKGF YPSDIAVEWESNGQPENNYKTTPPVLDSDGSFFLYSKLTVDKSRWQQGLCT PSRNVFSCSVMHEALHNHYTQKSLSLSPGK | 166 |
| 306F | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKC KVSNKALPAPIEKTISKAKGQPREPQVYTLPPSREEMTKNQVSLTCLVKGF YPSDIAVEWESNGQPENNYKTTPPVLDSDGSFFLYSKLTVDKSRWQQGNVL CTPSRFSCSVMHEALHNHYTQKSLSLSPGK | 167 |
| 307S | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKC KVSNKALPAPIEKTISKAKGQPREPQVYTLPPSREEMTKNQVSLTCLVKGF YPSDIAVEWESNGQPENNYKTTPPVLDSDGSFFLYSKLTVDKSRWQQGNVF LCTPSRSCSVMHEALHNHYTQKSLSLSPGK | 168 |
| 308C | ASTKGPSVFPLAPSSKSTSGGTAALGCLVKDYFPEPVTVSWNSGALTSGVH TFPAVLQSSGLYSLSSVVTVPSSSLGTQTYICNVNHKPSNTKVDKKVEPKS CDKTHTCPPCPAPELLGGPSVFLFPPKPKDTLMISRTPEVTCVVVDVSHED PEVKFNWYVDGVEVHNAKTKPREEQYNSTYRVVSVLTVLHQDWLNGKEYKC KVSNKALPAPIEKTISKAKGQPREPQVYTLPPSREEMTKNQVSLTCLVKGF YPSDIAVEWESNGQPENNYKTTPPVLDSDGSFFLYSKLTVDKSRWQQGNVF SLCTPSRCSVMHEALHNHYTQKSLSLSPGK | 169 |

FIG. 18 (Cont.)

| Table 10: CH3 Insertions | | |
|---|---|---|
| Position | Sequence | SEQ ID NO: |
| 320T | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYLCTPSRTQKSLSLSPGK | 170 |
| 321Q | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTLCTPSRQKSLSLSPGK | 171 |
| 322K | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQLCTPSRKSLSLSPGK | 172 |
| 323S | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKLCTPSRSLSLSPGK | 173 |
| 324L | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLCTPSRLSLSPGK | 174 |

FIG. 18 (Cont.)

| Table 10: CH3 Insertions | | |
|---|---|---|
| Position | Sequence | SEQ ID NO: |
| 325S | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLLCTPSRSLSPGK | 175 |
| 327S | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLLCTPSRSPGK | 176 |
| 328P | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSLCTPSRPGK | 177 |
| 329G | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPLCTPSRGK | 178 |

ANTIBODY CONJUGATES AND METHODS OF MAKING AND USING THE SAME

CROSS-REFERENCE TO RELATED APPLICATIONS

This application claims priority benefit of U.S. Provisional Application No. 62/473,161, filed Mar. 17, 2017, the disclosure of which is incorporated herein by reference in its entirety.

INTRODUCTION

Antibodies find use in various diagnostic and therapeutic applications. Antibodies can also be used to deliver drugs. However, conjugation of a drug to an antibody can be difficult to control, resulting in a heterogeneous mixture of conjugates that differ in the number of drug molecules attached. This can make controlling the amount administered to a patient difficult.

SUMMARY

Antibodies that include a sulfatase motif-containing tag in a constant region of an immunoglobulin (Ig) heavy chain polypeptide are disclosed. The sulfatase motif of the tag can be converted by a formylglycine-generating enzyme (FGE) to produce a formylglycine (fGly)-modified Ig heavy chain polypeptide. An fGly-modified Ig heavy chain polypeptide of the antibody can be covalently and site-specifically bound to a moiety of interest (i.e., a payload, e.g., drug) to provide an antibody conjugate. The disclosure also encompasses methods of production of such tagged Ig heavy chain polypeptides, fGly-modified Ig heavy chain polypeptides, and antibody conjugates, as well as methods of use of same.

Provided herein is a composition including an antibody containing an immunoglobulin (Ig) heavy chain polypeptide containing, in a constant region, an amino acid sequence of the formula: $X^1Z^1X^2Z^2X^3Z^3$, wherein $Z^1$ is cysteine, serine, 2-formylglycine (fGly), or fGly', wherein fGly' is an fGly residue covalently bound to a payload; $Z^2$ is proline or alanine; $Z^3$ is an aliphatic amino acid or a basic amino acid; $X^1$ is present or absent, and when present, can be any amino acid; and $X^2$ and $X^3$ are each independently any amino acid, wherein the amino acid sequence is not positioned at the C-terminus of the Ig heavy chain polypeptide and is positioned in the Ig heavy chain polypeptide such that when $Z^1$ is fGly, conjugation of the fGly with the payload provides an average molar ratio of payload to antibody of at least 0.5. In some embodiments, the constant region of the Ig heavy chain polypeptide includes the amino acid sequence:

| | |
|---|---|
| $X^1Z^1X^2Z^2X^3Z^3AS$; | (SEQ ID NO: 179) |
| $AX^1Z^1X^2Z^2X^3Z^3STK$; | (SEQ ID NO: 180) |
| $TX^1Z^1X^2Z^2X^3Z^3KGP$; | (SEQ ID NO: 181) |
| $KX^1Z^1X^2Z^2X^3Z^3GPSVFP$; | (SEQ ID NO: 182) |
| $PX^1Z^1X^2Z^2X^3Z^3SVFP$; | (SEQ ID NO: 183) |
| $PSX^1Z^1X^2Z^2X^3Z^3VFP$; | (SEQ ID NO: 184) |
| $VX^1Z^1X^2Z^2X^3Z^3FPL$; | (SEQ ID NO: 185) |
| $APX^1Z^1X^2Z^2X^3Z^3[SSK/CSR]$; | (SEQ ID NO: 186) |
| $SSX^1Z^1X^2Z^2X^3Z^3KST$; | (SEQ ID NO: 187) |
| $CSX^1Z^1X^2Z^2X^3Z^3RS$; | (SEQ ID NO: 188) |
| $[SK/-R]X^1Z^1X^2Z^2X^3Z^3STS$; | (SEQ ID NO: 189) |
| $KSX^1Z^1X^2Z^2X^3Z^3TSGG$; | (SEQ ID NO: 190) |
| $RSX^1Z^1X^2Z^2X^3Z^3TS[GG/E-]$; | (SEQ ID NO: 191) |
| $KSTX^1Z^1X^2Z^2X^3Z^3SGG$; | (SEQ ID NO: 192) |
| $RSTX^1Z^1X^2Z^2X^3Z^3S[GG/E-]$; | (SEQ ID NO: 193) |
| $TSX^1Z^1X^2Z^2X^3Z^3[GG/ES]T$; | (SEQ ID NO: 194) |
| $SGX^1Z^1X^2Z^2X^3Z^3GTA$; | (SEQ ID NO: 195) |
| $EX^1Z^1X^2Z^2X^3Z^3STA$; | (SEQ ID NO: 196) |
| $[GG/ES]X^1Z^1X^2Z^2X^3Z^3TA$; | (SEQ ID NO: 197) |
| $[-G/ES]TX^1Z^1X^2Z^2X^3Z^3AA$; | (SEQ ID NO: 198) |
| $TAX^1Z^1X^2Z^2X^3Z^3ALG$; | (SEQ ID NO: 199) |
| $AAX^1Z^1X^2Z^2X^3Z^3GC$; | (SEQ ID NO: 200) |
| $ALX^1Z^1X^2Z^2X^3Z^3GC$; | (SEQ ID NO: 201) |
| $PEX^1Z^1X^2Z^2X^3Z^3PVT$; | (SEQ ID NO: 202) |
| $VSX^1Z^1X^2Z^2X^3Z^3WN$; | (SEQ ID NO: 203) |
| $SWX^1Z^1X^2Z^2X^3Z^3NSG$; | (SEQ ID NO: 204) |
| $WNX^1Z^1X^2Z^2X^3Z^3SGA$; | (SEQ ID NO: 205) |
| $NSX^1Z^1X^2Z^2X^3Z^3GA$; | (SEQ ID NO: 206) |
| $NSGX^1Z^1X^2Z^2X^3Z^3ALT$; | (SEQ ID NO: 207) |
| $GAX^1Z^1X^2Z^2X^3Z^3LTS$; | (SEQ ID NO: 208) |
| $GALX^1Z^1X^2Z^2X^3Z^3TS$; | (SEQ ID NO: 209) |
| $LTX^1Z^1X^2Z^2X^3Z^3SGV$; | (SEQ ID NO: 210) |

-continued (SEQ ID NO: 211)
LTSX$^1$Z$^1$X$^2$Z$^2$X$^3$Z$^3$GVH;

(SEQ ID NO: 212)
LTSGX$^1$Z$^1$X$^2$Z$^2$X$^3$Z$^3$VHT;

(SEQ ID NO: 213)
GVX$^1$Z$^1$X$^2$Z$^2$X$^3$Z$^3$HTF;

(SEQ ID NO: 214)
VHX$^1$Z$^1$X$^2$Z$^2$X$^3$Z$^3$TFP;

(SEQ ID NO: 215)
HTX$^1$Z$^1$X$^2$Z$^2$X$^3$Z$^3$FPA;

(SEQ ID NO: 216)
QSX$^1$Z$^1$X$^2$Z$^2$X$^3$Z$^3$SG;

(SEQ ID NO: 217)
QSSX$^1$Z$^1$X$^2$Z$^2$X$^3$Z$^3$GLY;

(SEQ ID NO: 218)
SSGX$^1$Z$^1$X$^2$Z$^2$X$^3$Z$^3$LYSL;

(SEQ ID NO: 219)
GLX$^1$Z$^1$X$^2$Z$^2$X$^3$Z$^3$YSL;

(SEQ ID NO: 220)
LYX$^1$Z$^1$X$^2$Z$^2$X$^3$Z$^3$SLSS;

(SEQ ID NO: 221)
SLX$^1$Z$^1$X$^2$Z$^2$X$^3$Z$^3$SSV;

(SEQ ID NO: 222)
SSVX$^1$Z$^1$X$^2$Z$^2$X$^3$Z$^3$VTV;

(SEQ ID NO: 223)
VVX$^1$Z$^1$X$^2$Z$^2$X$^3$Z$^3$TVP;

(SEQ ID NO: 224)
VVTX$^1$Z$^1$X$^2$Z$^2$X$^3$Z$^3$VP;

(SEQ ID NO: 225)
VVTVX$^1$Z$^1$X$^2$Z$^2$X$^3$Z$^3$PSS[S/N];

(SEQ ID NO: 226)
VPX$^1$Z$^1$X$^2$Z$^2$X$^3$Z$^3$SSS;

(SEQ ID NO: 227)
VPSX$^1$Z$^1$X$^2$Z$^2$X$^3$Z$^3$S[SL/NF];

(SEQ ID NO: 228)
VPSSX$^1$Z$^1$X$^2$Z$^2$X$^3$Z$^3$[SLGT/NF--];

(SEQ ID NO: 229)
SSSX$^1$Z$^1$X$^2$Z$^2$X$^3$Z$^3$LGT;

(SEQ ID NO: 230)
SSNX$^1$Z$^1$X$^2$Z$^2$X$^3$Z$^3$FG;

(SEQ ID NO: 231)
[SSL/-NF]X$^1$Z$^1$X$^2$Z$^2$X$^3$Z$^3$GT;

(SEQ ID NO: 232)
SLGX$^1$Z$^1$X$^2$Z$^2$X$^3$Z$^3$T[Q/K]T;

(SEQ ID NO: 233)
FGX$^1$Z$^1$X$^2$Z$^2$X$^3$Z$^3$TQT;

(SEQ ID NO: 234)
LGTX$^1$Z$^1$X$^2$Z$^2$X$^3$Z$^3$[QT-/KTY];

(SEQ ID NO: 235)
FGTX$^1$Z$^1$X$^2$Z$^2$X$^3$Z$^3$QT;

(SEQ ID NO: 236)
TQX$^1$Z$^1$X$^2$Z$^2$X$^3$Z$^3$TY[I/T];

(SEQ ID NO: 237)
GTKX$^1$Z$^1$X$^2$Z$^2$X$^3$Z$^3$TYT;

-continued (SEQ ID NO: 238)
QTX$^1$Z$^1$X$^2$Z$^2$X$^3$Z$^3$Y[I-/TC];

(SEQ ID NO: 239)
TKTX$^1$Z$^1$X$^2$Z$^2$X$^3$Z$^3$YTC;

(SEQ ID NO: 240)
TYX$^1$Z$^1$X$^2$Z$^2$X$^3$Z$^3$[IC-/TCN];

(SEQ ID NO: 241)
Y[I/T]X$^1$Z$^1$X$^2$Z$^2$X$^3$Z$^3$CN;

(SEQ ID NO: 242)
NVX$^1$Z$^1$X$^2$Z$^2$X$^3$Z$^3$[NHK/DH-];

(SEQ ID NO: 243)
[N/D]HX$^1$Z$^1$X$^2$Z$^2$X$^3$Z$^3$KPS;

(SEQ ID NO: 244)
HKX$^1$Z$^1$X$^2$Z$^2$X$^3$Z$^3$PSN;

(SEQ ID NO: 245)
KPX$^1$Z$^1$X$^2$Z$^2$X$^3$Z$^3$SNT;

(SEQ ID NO: 246)
KPSX$^1$Z$^1$X$^2$Z$^2$X$^3$Z$^3$NTK;

(SEQ ID NO: 247)
PSNX$^1$Z$^1$X$^2$Z$^2$X$^3$Z$^3$TKV;

(SEQ ID NO: 248)
NTX$^1$Z$^1$X$^2$Z$^2$X$^3$Z$^3$KVD;

(SEQ ID NO: 249)
NTKX$^1$Z$^1$X$^2$Z$^2$X$^3$Z$^3$VDK[K/T/R];

(SEQ ID NO: 250)
KVX$^1$Z$^1$X$^2$Z$^2$X$^3$Z$^3$DK[K/T/R];
or (SEQ ID NO: 251)
DKX$^1$Z$^1$X$^2$Z$^2$X$^3$Z$^3$[K/T/R]VE.

In some embodiments, the constant region of the Ig heavy chain polypeptide includes the amino acid sequence:

(SEQ ID NO: 252)
VEX$^1$Z$^1$X$^2$Z$^2$X$^3$Z$^3$PKS;

(SEQ ID NO: 253)
VEPX$^1$Z$^1$X$^2$Z$^2$X$^3$Z$^3$KSC;

(SEQ ID NO: 254)
PKX$^1$Z$^1$X$^2$Z$^2$X$^3$Z$^3$SCD;

(SEQ ID NO: 255)
PKS$^X$1Z$^1$X$^2$Z$^2$X$^3$Z$^3$CD;

(SEQ ID NO: 256)
SCX$^1$Z$^1$X$^2$Z$^2$X$^3$Z$^3$DKT;

(SEQ ID NO: 257)
CRX$^1$Z$^1$X$^2$Z$^2$X$^3$Z$^3$KTH;

(SEQ ID NO: 258)
CDKX$^1$Z$^1$X$^2$Z$^2$X$^3$Z$^3$TH;

(SEQ ID NO: 259)
KTX$^1$Z$^1$X$^2$Z$^2$X$^3$Z$^3$HT;

(SEQ ID NO: 260)
THX$^1$Z$^1$X$^2$Z$^2$X$^3$Z$^3$TCP;

(SEQ ID NO: 261)
THTX$^1$Z$^1$X$^2$Z$^2$X$^3$Z$^3$CPP;

(SEQ ID NO: 262)
TCX$^1$Z$^1$X$^2$Z$^2$X$^3$Z$^3$PPC;

-continued

PPX$^1$Z$^1$X$^2$Z$^2$X$^3$Z$^3$CP; (SEQ ID NO: 263)

or

PCX$^1$Z$^1$X$^2$Z$^2$X$^3$Z$^3$PAPE. (SEQ ID NO: 264)

In some embodiments, the constant region of the Ig heavy chain polypeptide includes the amino acid sequence:

PCPX$^1$Z$^1$X$^2$Z$^2$X$^3$Z$^3$AP[E/P]; (SEQ ID NO: 265)

SCPX$^1$Z$^1$X$^2$Z$^2$X$^3$Z$^3$APE; (SEQ ID NO: 266)

CPAX$^1$Z$^1$X$^2$Z$^2$X$^3$Z$^3$[EL/EF/PV]; (SEQ ID NO: 267)

CPAPX$^1$Z$^1$X$^2$Z$^2$X$^3$Z$^3$E[L/F]L; (SEQ ID NO: 268)

CPAPX$^1$Z$^1$X$^2$Z$^2$X$^3$Z$^3$PVA; (SEQ ID NO: 269)

PE[L/F]X$^1$Z$^1$X$^2$Z$^2$X$^3$Z$^3$LGG; (SEQ ID NO: 270)

[L/F]LX$^1$Z$^1$X$^2$Z$^2$X$^3$Z$^3$GG; (SEQ ID NO: 271)

[LG/VA]GX$^1$Z$^1$X$^2$Z$^2$X$^3$Z$^3$PSV; (SEQ ID NO: 272)

[G/A]GPX$^1$Z$^1$X$^2$Z$^2$X$^3$Z$^3$SVF; (SEQ ID NO: 273)

ISX$^1$Z$^1$X$^2$Z$^2$X$^3$Z$^3$RT; (SEQ ID NO: 274)

ISRX$^1$Z$^1$X$^2$Z$^2$X$^3$Z$^3$TPE; (SEQ ID NO: 275)

RTX$^1$Z$^1$X$^2$Z$^2$X$^3$Z$^3$PEVT; (SEQ ID NO: 276)

DVX$^1$Z$^1$X$^2$Z$^2$X$^3$Z$^3$S[H--/QED]; (SEQ ID NO: 277)

DVSX$^1$Z$^1$X$^2$Z$^2$X$^3$Z$^3$[H/Q]ED; (SEQ ID NO: 278)

[-SH/VSQ]X$^1$Z$^1$X$^2$Z$^2$X$^3$Z$^3$ED; (SEQ ID NO: 279)

[H/Q]EX$^1$Z$^1$X$^2$Z$^2$X$^3$Z$^3$DP; (SEQ ID NO: 280)

EDX$^1$Z$^1$X$^2$Z$^2$X$^3$Z$^3$PEV; (SEQ ID NO: 281)

DPX$^1$Z$^1$X$^2$Z$^2$X$^3$Z$^3$EV[K/Q]; (SEQ ID NO: 282)

EVRX$^1$Z$^1$X$^2$Z$^2$X$^3$Z$^3$FN; (SEQ ID NO: 283)

EVQX$^1$Z$^1$X$^2$Z$^2$X$^3$Z$^3$F[NW/K-]; (SEQ ID NO: 284)

GVEX$^1$Z$^1$X$^2$Z$^2$X$^3$Z$^3$VHN; (SEQ ID NO: 285)

VEVX$^1$Z$^1$X$^2$Z$^2$X$^3$Z$^3$HNA; (SEQ ID NO: 286)

EVHX$^1$Z$^1$X$^2$Z$^2$X$^3$Z$^3$NA; (SEQ ID NO: 287)

HNX$^1$Z$^1$X$^2$Z$^2$X$^3$Z$^3$AKT; (SEQ ID NO: 288)

NAX$^1$Z$^1$X$^2$Z$^2$X$^3$Z$^3$KTKP; (SEQ ID NO: 289)

AKX$^1$Z$^1$X$^2$Z$^2$X$^3$Z$^3$TKP; (SEQ ID NO: 290)

EQX$^1$Z$^1$X$^2$Z$^2$X$^3$Z$^3$[YNS/FN-]; (SEQ ID NO: 291)

NSTX$^1$Z$^1$X$^2$Z$^2$X$^3$Z$^3$[Y/F]R; (SEQ ID NO: 292)

ST[Y/F]X$^1$Z$^1$X$^2$Z$^2$X$^3$Z$^3$RV; (SEQ ID NO: 293)

[Y/F]RX$^1$Z$^1$X$^2$Z$^2$X$^3$Z$^3$VVS; (SEQ ID NO: 294)

[Y/F]RVX$^1$Z$^1$X$^2$Z$^2$X$^3$Z$^3$VSV; (SEQ ID NO: 295)

RVVX$^1$Z$^1$X$^2$Z$^2$X$^3$Z$^3$SVL; (SEQ ID NO: 296)

VSNX$^1$Z$^1$X$^2$Z$^2$X$^3$Z$^3$K[A/G]L; (SEQ ID NO: 297)

NKX$^1$Z$^1$X$^2$Z$^2$X$^3$Z$^3$[ALP/GL-]; (SEQ ID NO: 298)

KAX$^1$Z$^1$X$^2$Z$^2$X$^3$Z$^3$LPA; (SEQ ID NO: 299)

NKGX$^1$Z$^1$X$^2$Z$^2$X$^3$Z$^3$LP[A/S]; (SEQ ID NO: 300)

ALPX$^1$Z$^1$X$^2$Z$^2$X$^3$Z$^3$AP; (SEQ ID NO: 301)

GLPX$^1$Z$^1$X$^2$Z$^2$X$^3$Z$^3$[AP/SS]; (SEQ ID NO: 302)

LPAX$^1$Z$^1$X$^2$Z$^2$X$^3$Z$^3$PI; (SEQ ID NO: 303)

LPSX$^1$Z$^1$X$^2$Z$^2$X$^3$Z$^3$SI; (SEQ ID NO: 304)

LP[AP/SS]X$^1$Z$^1$X$^2$Z$^2$X$^3$Z$^3$IE; (SEQ ID NO: 305)

TISX$^1$Z$^1$X$^2$Z$^2$X$^3$Z$^3$K[A-/TK]; (SEQ ID NO: 306)

or

ISKX$^1$Z$^1$X$^2$Z$^2$X$^3$Z$^3$[AK-/TKG]. (SEQ ID NO: 307)

In some embodiments, the constant region of the Ig heavy chain polypeptide includes the amino acid sequence:

[-KA/SKT]KX$^1$Z$^1$X$^2$Z$^2$X$^3$Z$^3$GQPR; (SEQ ID NO: 308)

[A/T]KGX$^1$Z$^1$X$^2$Z$^2$X$^3$Z$^3$QPR; (SEQ ID NO: 309)

QPX$^1$Z$^1$X$^2$Z$^2$X$^3$Z$^3$REP; (SEQ ID NO: 310)

QPRX$^1$Z$^1$X$^2$Z$^2$X$^3$Z$^3$EP; (SEQ ID NO: 311)

REPX$^1$Z$^1$X$^2$Z$^2$X$^3$Z$^3$QVY; (SEQ ID NO: 312)

-continued (SEQ ID NO: 313)
YTL$X^1Z^1X^2Z^2X^3Z^3$PPS;

(SEQ ID NO: 314)
TLP$X^1Z^1X^2Z^2X^3Z^3$PS[R/Q];

(SEQ ID NO: 315)
LPP$X^1Z^1X^2Z^2X^3Z^3$S[RE/RD/Q-];

(SEQ ID NO: 316)
PPS$X^1Z^1X^2Z^2X^3Z^3$[RE-/RD-/QEE];

(SEQ ID NO: 317)
PSR$X^1Z^1X^2Z^2X^3Z^3$[EE/DE];

(SEQ ID NO: 318)
PSQ$X^1Z^1X^2Z^2X^3Z^3$EE;

(SEQ ID NO: 319)
[-SR/PSQ]E$X^1Z^1X^2Z^2X^3Z^3$EM;

(SEQ ID NO: 320)
RD$X^1Z^1X^2Z^2X^3Z^3$EL;

(SEQ ID NO: 321)
[SR/-Q]EE$X^1Z^1X^2Z^2X^3Z^3$MT;

(SEQ ID NO: 322)
DE$X^1Z^1X^2Z^2X^3Z^3$LTK;

(SEQ ID NO: 323)
[-M/EL]T$X^1Z^1X^2Z^2X^3Z^3$KN;

(SEQ ID NO: 324)
[M/L]TK$X^1Z^1X^2Z^2X^3Z^3$NQ;

(SEQ ID NO: 325)
NQ$X^1Z^1X^2Z^2X^3Z^3$VS;

(SEQ ID NO: 326)
NQV$X^1Z^1X^2Z^2X^3Z^3$SLT;

(SEQ ID NO: 327)
TCLVK$X^1Z^1X^2Z^2X^3Z^3$GF;

(SEQ ID NO: 328)
EY$X^1Z^1X^2Z^2X^3Z^3$PS;

(SEQ ID NO: 329)
[A/S]VE$X^1Z^1X^2Z^2X^3Z^3$WE;

(SEQ ID NO: 330)
WES$X^1Z^1X^2Z^2X^3Z^3$[N/S]G;

(SEQ ID NO: 331)
ES[N/S]$X^1Z^1X^2Z^2X^3Z^3$GQ;

(SEQ ID NO: 332)
[-SN/ESS]G$X^1Z^1X^2Z^2X^3Z^3$QP;

(SEQ ID NO: 333)
[N/S]GQ$X^1Z^1X^2Z^2X^3Z^3$PE;

(SEQ ID NO: 334)
[N/S]GQP$X^1Z^1X^2Z^2X^3Z^3$EN;

(SEQ ID NO: 335)
QPE$X^1Z^1X^2Z^2X^3Z^3$NN;

(SEQ ID NO: 336)
EN$X^1Z^1X^2Z^2X^3Z^3$NY;

(SEQ ID NO: 337)
NN$X^1Z^1X^2Z^2X^3Z^3$Y[K/N];

(SEQ ID NO: 338)
NY$X^1Z^1X^2Z^2X^3Z^3$[K/N]T;

(SEQ ID NO: 339)
NY[K/N]$X^1Z^1X^2Z^2X^3Z^3$TT;

-continued (SEQ ID NO: 340)
Y[K/N]T$X^1Z^1X^2Z^2X^3Z^3$TP;

(SEQ ID NO: 341)
TTP$X^1Z^1X^2Z^2X^3Z^3$P[V/M];

(SEQ ID NO: 342)
LD$X^1Z^1X^2Z^2X^3Z^3$SD;

(SEQ ID NO: 343)
DS$X^1Z^1X^2Z^2X^3Z^3$DG;

(SEQ ID NO: 344)
DSD$X^1Z^1X^2Z^2X^3Z^3$GS;

(SEQ ID NO: 345)
SDG$X^1Z^1X^2Z^2X^3Z^3$SF;

(SEQ ID NO: 346)
GS$X^1Z^1X^2Z^2X^3Z^3$FF;

(SEQ ID NO: 347)
SFX$X^1Z^1X^2Z^2X^3Z^3$FL;

(SEQ ID NO: 348)
[K/R]LT$X^1Z^1X^2Z^2X^3Z^3$VD;

(SEQ ID NO: 349)
[K/R]LTV$X^1Z^1X^2Z^2X^3Z^3$DK;

(SEQ ID NO: 350)
TVD$X^1Z^1X^2Z^2X^3Z^3$KSR;

(SEQ ID NO: 351)
TVDK$X^1Z^1X^2Z^2X^3Z^3$SR;

(SEQ ID NO: 352)
DKS$X^1Z^1X^2Z^2X^3Z^3$RW;

(SEQ ID NO: 353)
KSR$X^1Z^1X^2Z^2X^3Z^3$WQ;

(SEQ ID NO: 354)
RW$X^1Z^1X^2Z^2X^3Z^3$QQ;

(SEQ ID NO: 355)
WQ$X^1Z^1X^2Z^2X^3Z^3$QG;

(SEQ ID NO: 356)
[-QQ/WQE]$X^1Z^1X^2Z^2X^3Z^3$GN;

(SEQ ID NO: 357)
[Q/E]G$X^1Z^1X^2Z^2X^3Z^3$NV;

(SEQ ID NO: 358)
[GNV/-NI]$X^1Z^1X^2Z^2X^3Z^3$FS;

(SEQ ID NO: 359)
[NV/-I]F$X^1Z^1X^2Z^2X^3Z^3$SCS;

(SEQ ID NO: 360)
FS$X^1Z^1X^2Z^2X^3Z^3$CS;

(SEQ ID NO: 361)
[HY/RF]$X^1Z^1X^2Z^2X^3Z^3$TQ;

(SEQ ID NO: 362)
[HY/-F]T$X^1Z^1X^2Z^2X^3Z^3$QK;

(SEQ ID NO: 363)
[Y/F]TQ$X^1Z^1X^2Z^2X^3Z^3$KS;

(SEQ ID NO: 364)
QK$X^1Z^1X^2Z^2X^3Z^3$SLSLS;

(SEQ ID NO: 365)
QKS$X^1Z^1X^2Z^2X^3Z^3$LSLS;

(SEQ ID NO: 366)
KSL$X^1Z^1X^2Z^2X^3Z^3$SLS;

KSLSLX$^1$Z$^1$X$^2$Z$^2$X$^3$Z$^3$S; (SEQ ID NO: 367)

LSLSX$^1$Z$^1$X$^2$Z$^2$X$^3$Z$^3$[P/L]; (SEQ ID NO: 368)
or

[---SP/LSLSL]X$^1$Z$^1$X$^2$Z$^2$X$^3$Z$^3$G. (SEQ ID NO: 369)

In any embodiment, Z$^3$ may be arginine. In any embodiment, X$^1$ may be present. In some embodiments, X$^1$ is glycine, leucine, isoleucine, methionine, histidine, tyrosine, valine, serine, cysteine or threonine.

In any embodiment, X$^2$ and X$^3$ may each independently be serine, threonine, alanine, valine, glycine or cysteine.

In any embodiment, the Ig heavy chain polypeptide may be IgG1.

In any embodiment, the Ig heavy chain polypeptide constant region may include two or more of SEQ ID NOs:179-369.

In any embodiment, the antibody may specifically bind a tumor antigen on a cancer cell.

In some embodiments, X$^1$Z$^1$X$^2$Z$^2$X$^3$Z$^3$ is LCTPSR (SEQ ID NO:561) or LSTPSR (SEQ ID NO:562). In some embodiments, X$^1$Z$^1$X$^2$Z$^2$X$^3$Z$^3$ is selected from MCTPSR (SEQ ID NO:563), VCTPSR (SEQ ID NO:564), LCSPSR (SEQ ID NO:565), LCAPSR (SEQ ID NO:566), LCVPSR (SEQ ID NO:567), LCGPSR (SEQ ID NO:568), ICTPAR (SEQ ID NO:569), LCTPSK (SEQ ID NO:570), MCTPSK (SEQ ID NO:571), VCTPSK (SEQ ID NO:572), LCSPSK (SEQ ID NO:573), LCAPSK (SEQ ID NO:574), LCVPSK (SEQ ID NO:575), LCGPSK (SEQ ID NO:576), LCTPSA (SEQ ID NO:577), ICTPAA (SEQ ID NO:578), MCTPSA (SEQ ID NO:579), VCTPSA (SEQ ID NO:580), LCSPSA (SEQ ID NO:581), LCAPSA (SEQ ID NO:582), LCVPSA (SEQ ID NO:583), LCGPSA (SEQ ID NO:584), MSTPSR (SEQ ID NO:585), VSTPSR (SEQ ID NO:586), LSSPSR (SEQ ID NO:587), LSAPSR (SEQ ID NO:588), LSVPSR (SEQ ID NO:589), LSGPSR (SEQ ID NO:590), ISTPAR (SEQ ID NO:591), LSTPSK (SEQ ID NO:592), MSTPSK (SEQ ID NO:593), VSTPSK (SEQ ID NO:594), LSSPSK (SEQ ID NO:595), LSAPSK (SEQ ID NO:596), LSVPSK (SEQ ID NO:597), LSGPSK (SEQ ID NO:598), LSTPSA (SEQ ID NO:599), ISTPAA (SEQ ID NO:600), MSTPSA (SEQ ID NO:601), VSTPSA (SEQ ID NO:602), LSSPSA (SEQ ID NO:603), LSAPSA (SEQ ID NO:604), LSVPSA (SEQ ID NO:605), and LSGPSA (SEQ ID NO:606).

Also provided herein is a composition according to any embodiment, the composition containing an fGly-modified antibody containing the antibody, wherein Z$^1$ is fGly. In some embodiments, X$^1$Z$^1$X$^2$Z$^2$X$^3$Z$^3$ is L(fGly)TPSR (SEQ ID NO:607). In some embodiments, X$^1$Z$^1$X$^2$Z$^2$X$^3$Z$^3$ is selected from M(fGly)TPSR (SEQ ID NO:608), V(fGly)TPSR (SEQ ID NO:609), L(fGly)SPSR (SEQ ID NO:610), L(fGly)APSR (SEQ ID NO:611), L(fGly)VPSR (SEQ ID NO:612), L(fGly)GPSR (SEQ ID NO:613), I(fGly)TPAR (SEQ ID NO:614), L(fGly)TPSK (SEQ ID NO:615), M(fGly)TPSK (SEQ ID NO:616), V(fGly)TPSK (SEQ ID NO:617), L(fGly)SPSK (SEQ ID NO:618), L(fGly)APSK (SEQ ID NO:619), L(fGly)VPSK (SEQ ID NO:620), L(fGly)GPSK (SEQ ID NO:621), L(fGly)TPSA (SEQ ID NO:622), I(fGly)TPAA (SEQ ID NO:623), M(fGly)TPSA (SEQ ID NO:624), V(fGly)TPSA (SEQ ID NO:625), L(fGly)SPSA (SEQ ID NO:626), L(fGly)APSA (SEQ ID NO:627), L(fGly)VPSA (SEQ ID NO:628), and L(fGly)GPSA (SEQ ID NO:629).

Also provided herein is a composition according to any embodiment, the composition containing an antibody conjugate containing the antibody covalently bound to the payload, wherein Z$^1$ is fGly'. In some embodiments, X$^1$(fGly')X$^2$Z$^2$X$^3$Z$^3$ is L(fGly')TPSR (SEQ ID NO:630). In some embodiments, X$^1$ (fGly')X$^2$Z$^2$X$^3$Z$^3$ is selected from M(fGly')TPSR (SEQ ID NO:631), V(fGly')TPSR (SEQ ID NO:632), L(fGly')SPSR (SEQ ID NO:633), L(fGly')APSR (SEQ ID NO:634), L(fGly')VPSR (SEQ ID NO:635), L(fGly')GPSR (SEQ ID NO:636), I(fGly')TPAR (SEQ ID NO:637), L(fGly')TPSK (SEQ ID NO:638), M(fGly')TPSK (SEQ ID NO:639), V(fGly')TPSK (SEQ ID NO:640), L(fGly')SPSK (SEQ ID NO:641), L(fGly')APSK (SEQ ID NO:642), L(fGly')VPSK (SEQ ID NO:643), L(fGly')GPSK (SEQ ID NO:644), L(fGly')TPSA (SEQ ID NO:645), I(fGly')TPAA (SEQ ID NO:646), M(fGly')TPSA (SEQ ID NO:647), V(fGly')TPSA (SEQ ID NO:648), L(fGly')SPSA (SEQ ID NO:649), L(fGly')APSA (SEQ ID NO:650), L(fGly')VPSA (SEQ ID NO:651), and L(fGly')GPSA (SEQ ID NO:652).

In any embodiment, the antibody may be covalently bound to the payload via a hydrazone, oxime, semicarbazone, alkyl, alkenyl, acyloxy, hydrazinyl-indolyl, hydrazinyl-imidazoyl, hydrazinyl-pyrrolyl, hydrazinyl-furanyl or a pyrazalinone linkage.

In any embodiment, the antibody may be covalently bound to the payload via a linking group. In some embodiments, the linking group includes a 4-aminopiperidine derivative (4AP).

In some embodiments, the payload is selected from a drug, a detectable label, a water-soluble polymer, and a synthetic peptide. In some embodiments, the payload is a small molecule drug. In some embodiments, the small molecule drug is a cancer chemotherapeutic agent. In some embodiments, the cancer chemotherapeutic agent is an alkylating agent, a nitrosourea, an antimetabolite, an antitumor antibiotic, a vinca alkaloid, or a steroid hormone. In some embodiments, the water-soluble polymer is poly(ethylene glycol). In some embodiments, the detectable label is an imaging agent. In some embodiments, the payload is a viral fusion inhibitor.

In some embodiments, the constant region of the Ig heavy chain polypeptide includes the amino acid sequence:

X$^1$(fGly')X$^2$Z$^2$X$^3$Z$^3$AS; (SEQ ID NO: 370)

AX$^1$(fGly')X$^2$Z$^2$X$^3$Z$^3$STK; (SEQ ID NO: 371)

TX$^1$(fGly')X$^2$Z$^2$X$^3$Z$^3$KGP; (SEQ ID NO: 372)

KX$^1$(fGly')X$^2$Z$^2$X$^3$Z$^3$GPSVFP; (SEQ ID NO: 373)

PX$^1$(fGly')X$^2$Z$^2$X$^3$Z$^3$SVFP; (SEQ ID NO: 374)

PSX$^1$(fGly')X$^2$Z$^2$X$^3$Z$^3$VFP; (SEQ ID NO: 375)

VX$^1$(fGly')X$^2$Z$^2$X$^3$Z$^3$FPL; (SEQ ID NO: 376)

APX$^1$(fGly')X$^2$Z$^2$X$^3$Z$^3$[SSK/CSR]; (SEQ ID NO: 377)

SSX$^1$(fGly')X$^2$Z$^2$X$^3$Z$^3$KST; (SEQ ID NO: 378)

CSX$^1$(fGly')X$^2$Z$^2$X$^3$Z$^3$RS; (SEQ ID NO: 379)

[SK/-R]X$^1$(fGly')X$^2$Z$^2$X$^3$Z$^3$STS; (SEQ ID NO: 380)

KSX$^1$(fGly')X$^2$Z$^2$X$^3$Z$^3$TSGG; (SEQ ID NO: 381)

RSX$^1$(fGly')X$^2$Z$^2$X$^3$Z$^3$TS[GG/E-]; (SEQ ID NO: 382)

KSTX$^1$(fGly')X$^2$Z$^2$X$^3$Z$^3$SGG; (SEQ ID NO: 383)

RSTX$^1$(fGly')X$^2$Z$^2$X$^3$Z$^3$S[GG/E-]; (SEQ ID NO: 384)

TSX$^1$(fGly')X$^2$Z$^2$X$^3$Z$^3$[GG/ES]T; (SEQ ID NO: 385)

SGX$^1$(fGly')X$^2$Z$^2$X$^3$Z$^3$GTA; (SEQ ID NO: 386)

EX$^1$(fGly')X$^2$Z$^2$X$^3$Z$^3$STA; (SEQ ID NO: 387)

[GG/ES]X$^1$(fGly')X$^2$Z$^2$X$^3$Z$^3$TA; (SEQ ID NO: 388)

[-G/ES]TX$^1$(fGly')X$^2$Z$^2$X$^3$Z$^3$AA; (SEQ ID NO: 389)

TAX$^1$(fGly')X$^2$Z$^2$X$^3$Z$^3$ALG; (SEQ ID NO: 390)

AAX$^1$(fGly')X$^2$Z$^2$X$^3$Z$^3$LGC; (SEQ ID NO: 391)

ALX$^1$(fGly')X$^2$Z$^2$X$^3$Z$^3$GC; (SEQ ID NO: 392)

PEX$^1$(fGly')X$^2$Z$^2$X$^3$Z$^3$PVT; (SEQ ID NO: 393)

VSX$^1$(fGly')X$^2$Z$^2$X$^3$Z$^3$WN; (SEQ ID NO: 394)

SWX$^1$(fGly')X$^2$Z$^2$X$^3$Z$^3$NSG; (SEQ ID NO: 395)

WNX$^1$(fGly')X$^2$Z$^2$X$^3$Z$^3$SGA; (SEQ ID NO: 396)

NSX$^1$(fGly')X$^2$Z$^2$X$^3$Z$^3$GA; (SEQ ID NO: 397)

NSGX$^1$(fGly')X$^2$Z$^2$X$^3$Z$^3$ALT; (SEQ ID NO: 398)

GAX$^1$(fGly')X$^2$Z$^2$X$^3$Z$^3$LTS; (SEQ ID NO: 399)

GALX$^1$(fGly')X$^2$Z$^2$X$^3$Z$^3$TS; (SEQ ID NO: 400)

LTX$^1$(fGly')X$^2$Z$^2$X$^3$Z$^3$SGV; (SEQ ID NO: 401)

LTSX$^1$(fGly')X$^2$Z$^2$X$^3$Z$^3$GVH; (SEQ ID NO: 402)

LTSGX$^1$(fGly')X$^2$Z$^2$X$^3$Z$^3$VHT; (SEQ ID NO: 403)

GVX$^1$(fGly')X$^2$Z$^2$X$^3$Z$^3$HTF; (SEQ ID NO: 404)

VHX$^1$(fGly')X$^2$Z$^2$X$^3$Z$^3$TFP; (SEQ ID NO: 405)

HTX$^1$(fGly')X$^2$Z$^2$X$^3$Z$^3$FPA; (SEQ ID NO: 406)

QSX$^1$(fGly')X$^2$Z$^2$X$^3$Z$^3$SG; (SEQ ID NO: 407)

QSSX$^1$(fGly')X$^2$Z$^2$X$^3$Z$^3$GLY; (SEQ ID NO: 408)

SSGX$^1$(fGly')X$^2$Z$^2$X$^3$Z$^3$LYSL; (SEQ ID NO: 409)

GLX$^1$(fGly')X$^2$Z$^2$X$^3$Z$^3$YSL; (SEQ ID NO: 410)

LYX$^1$(fGly')X$^2$Z$^2$X$^3$Z$^3$SLSS; (SEQ ID NO: 411)

SLX$^1$(fGly')X$^2$Z$^2$X$^3$Z$^3$SSV; (SEQ ID NO: 412)

SSVX$^1$(fGly')X$^2$Z$^2$X$^3$Z$^3$VTV; (SEQ ID NO: 413)

VVX$^1$(fGly')X$^2$Z$^2$X$^3$Z$^3$TVP; (SEQ ID NO: 414)

VVTX$^1$(fGly')X$^2$Z$^2$X$^3$Z$^3$VP; (SEQ ID NO: 415)

VVTVX$^1$(fGly')X$^2$Z$^2$X$^3$Z$^3$PSS[S/N]; (SEQ ID NO: 416)

VPX$^1$(fGly')X$^2$Z$^2$X$^3$Z$^3$SSS; (SEQ ID NO: 417)

VPSX$^1$(fGly')X$^2$Z$^2$X$^3$Z$^3$S[SL/NF]; (SEQ ID NO: 418)

VPSSX$^1$(fGly')X$^2$Z$^2$X$^3$Z$^3$[SLGT/NF--]; (SEQ ID NO: 419)

SSSX$^1$(fGly')X$^2$Z$^2$X$^3$Z$^3$LGT; (SEQ ID NO: 420)

SSNX$^1$(fGly')X$^2$Z$^2$X$^3$Z$^3$FG; (SEQ ID NO: 421)

[SSL/-NF]X$^1$(fGly')X$^2$Z$^2$X$^3$Z$^3$GT; (SEQ ID NO: 422)

SLGX$^1$(fGly')X$^2$Z$^2$X$^3$Z$^3$T[Q/K]T; (SEQ ID NO: 423)

FGX$^1$(fGly')X$^2$Z$^2$X$^3$Z$^3$TQT; (SEQ ID NO: 424)

LGTX$^1$(fGly')X$^2$Z$^2$X$^3$Z$^3$[QT-/KTY]; (SEQ ID NO: 425)

FGTX$^1$(fGly')X$^2$Z$^2$X$^3$Z$^3$QT; (SEQ ID NO: 426)

TQX$^1$(fGly')X$^2$Z$^2$X$^3$Z$^3$TY[I/T]; (SEQ ID NO: 427)

GTKX$^1$(fGly')X$^2$Z$^2$X$^3$Z$^3$TYT; (SEQ ID NO: 428)

QTX$^1$(fGly')X$^2$Z$^2$X$^3$Z$^3$Y[I-/TC]; (SEQ ID NO: 429)

TKTX$^1$(fGly')X$^2$Z$^2$X$^3$Z$^3$YTC; (SEQ ID NO: 430)

TYX$^1$(fGly')X$^2$Z$^2$X$^3$Z$^3$[IC-/TCN]; (SEQ ID NO: 431)

Y[I/T]X$^1$(fGly')X$^2$Z$^2$X$^3$Z$^3$CN; (SEQ ID NO: 432)

NVX$^1$(fGly')X$^2$Z$^2$X$^3$Z$^3$[NHK/DH-]; (SEQ ID NO: 433)

[N/D]HX$^1$(fGly')X$^2$Z$^2$X$^3$Z$^3$KPS; (SEQ ID NO: 434)

HKX$^1$(fGly')X$^2$Z$^2$X$^3$Z$^3$PSN; (SEQ ID NO: 435)

KPX$^1$(fGly')X$^2$Z$^2$X$^3$Z$^3$SNT; (SEQ ID NO: 436)

KPSX$^1$(fGly')X$^2$Z$^2$X$^3$Z$^3$NTK; (SEQ ID NO: 437)

PSNX$^1$(fGly')X$^2$Z$^2$X$^3$Z$^3$TKV; (SEQ ID NO: 438)

NTX$^1$(fGly')X$^2$Z$^2$X$^3$Z$^3$KVD; (SEQ ID NO: 439)

NTKX$^1$(fGly')X$^2$Z$^2$X$^3$Z$^3$VDK[K/T/R]; (SEQ ID NO: 440)

KVX$^1$(fGly')X$^2$Z$^2$X$^3$Z$^3$DK[K/T/R]; (SEQ ID NO: 441)
or

DKX$^1$(fGly')X$^2$Z$^2$X$^3$Z$^3$[K/T/R]VE. (SEQ ID NO: 442)

In some embodiments, the constant region of the Ig heavy chain polypeptide includes the amino acid sequence:

VEX$^1$(fGly')X$^2$Z$^2$X$^3$Z$^3$PKS; (SEQ ID NO: 443)

VEPX$^1$(fGly')X$^2$Z$^2$X$^3$Z$^3$KSC; (SEQ ID NO: 444)

PKX$^1$(fGly')X$^2$Z$^2$X$^3$Z$^3$SCD; (SEQ ID NO: 445)

PKSX$^1$(fGly')X$^2$Z$^2$X$^3$Z$^3$CD; (SEQ ID NO: 446)

SCX$^1$(fGly')X$^2$Z$^2$X$^3$Z$^3$DKT; (SEQ ID NO: 447)

CDX$^1$(fGly')X$^2$Z$^2$X$^3$Z$^3$KTH; (SEQ ID NO: 448)

CDKX$^1$(fGly')X$^2$Z$^2$X$^3$Z$^3$TH; (SEQ ID NO: 449)

KTX$^1$(fGly')X$^2$Z$^2$X$^3$Z$^3$HT; (SEQ ID NO: 450)

THX$^1$(fGly')X$^2$Z$^2$X$^3$Z$^3$TCP; (SEQ ID NO: 451)

THTX$^1$(fGly')X$^2$Z$^2$X$^3$Z$^3$CPP; (SEQ ID NO: 452)

TCX$^1$(fGly')X$^2$Z$^2$X$^3$Z$^3$PPC; (SEQ ID NO: 453)

PPX$^1$(fGly')X$^2$Z$^2$X$^3$Z$^3$CP; (SEQ ID NO: 454)
or

PCX$^1$(fGly')X$^2$Z$^2$X$^3$Z$^3$PAPE. (SEQ ID NO: 455)

In any embodiment, the constant region of the Ig heavy chain polypeptide includes the amino acid sequence:

PCPX$^1$(fGly')X$^2$Z$^2$X$^3$Z$^3$AP[E/P]; (SEQ ID NO: 456)

SCPX$^1$(fGly')X$^2$Z$^2$X$^3$Z$^3$APE; (SEQ ID NO: 457)

CPAX$^1$(fGly')X$^2$Z$^2$X$^3$Z$^3$P[EL/EF/PV]; (SEQ ID NO: 458)

CPAPX$^1$(fGly')X$^2$Z$^2$X$^3$Z$^3$E[L/F]L; (SEQ ID NO: 459)

CPAPX$^1$(fGly')X$^2$Z$^2$X$^3$Z$^3$PVA; (SEQ ID NO: 460)

PE[L/F]X$^1$(fGly')X$^2$Z$^2$X$^3$Z$^3$LGG; (SEQ ID NO: 461)

[L/F]LX$^1$(fGly')X$^2$Z$^2$X$^3$Z$^3$GG; (SEQ ID NO: 462)

[LG/VA]GX$^1$(fGly')X$^2$Z$^2$X$^3$Z$^3$PSV; (SEQ ID NO: 463)

[G/A]GPX$^1$(fGly')X$^2$Z$^2$X$^3$Z$^3$SVF; (SEQ ID NO: 464)

ISX$^1$(fGly')X$^2$Z$^2$X$^3$Z$^3$RT; (SEQ ID NO: 465)

ISRX$^1$(fGly')X$^2$Z$^2$X$^3$Z$^3$TPE; (SEQ ID NO: 466)

RTX$^1$(fGly')X$^2$Z$^2$X$^3$Z$^3$PEVT; (SEQ ID NO: 467)

DVX$^1$(fGly')X$^2$Z$^2$X$^3$Z$^3$S[H--/QED]; (SEQ ID NO: 468)

DVSX$^1$(fGly')X$^2$Z$^2$X$^3$Z$^3$[H/Q]ED; (SEQ ID NO: 469)

[-SH/VSQ]X$^1$(fGly')X$^2$Z$^2$X$^3$Z$^3$ED; (SEQ ID NO: 470)

[H/Q]EX$^1$(fGly')X$^2$Z$^2$X$^3$Z$^3$DP; (SEQ ID NO: 471)

EDX$^1$(fGly')X$^2$Z$^2$X$^3$Z$^3$PEV; (SEQ ID NO: 472)

DPX$^1$(fGly')X$^2$Z$^2$X$^3$Z$^3$EV[K/Q]; (SEQ ID NO: 473)

EVKX$^1$(fGly')X$^2$Z$^2$X$^3$Z$^3$FN; (SEQ ID NO: 474)

EVQX$^1$(fGly')X$^2$Z$^2$X$^3$Z$^3$F[NW/K-]; (SEQ ID NO: 475)

GVEX$^1$(fGly')X$^2$Z$^2$X$^3$Z$^3$VHN; (SEQ ID NO: 476)

VEVX$^1$(fGly')X$^2$Z$^2$X$^3$Z$^3$HNA; (SEQ ID NO: 477)

EVHX$^1$(fGly')X$^2$Z$^2$X$^3$Z$^3$NA; (SEQ ID NO: 478)

HNX$^1$(fGly')X$^2$Z$^2$X$^3$Z$^3$AKT; (SEQ ID NO: 479)

NAX$^1$(fGly')X$^2$Z$^2$X$^3$Z$^3$KTKP; (SEQ ID NO: 480)

AKX$^1$(fGly')X$^2$Z$^2$X$^3$Z$^3$TKP; (SEQ ID NO: 481)

EQX$^1$(fGly')X$^2$Z$^2$X$^3$Z$^3$[YNS/FN-]; (SEQ ID NO: 482)

NSTX$^1$(fGly')X$^2$Z$^2$X$^3$Z$^3$[Y/F]R;  (SEQ ID NO: 483)

ST[Y/F]X$^1$(fGly')X$^2$Z$^2$X$^3$Z$^3$RV;  (SEQ ID NO: 484)

[Y/F]RX$^1$(fGly')X$^2$Z$^2$X$^3$Z$^3$VVS;  (SEQ ID NO: 485)

[Y/F]RVX$^1$(fGly')X$^2$Z$^2$X$^3$Z$^3$VSV;  (SEQ ID NO: 486)

RVVX$^1$(fGly')X$^2$Z$^2$X$^3$Z$^3$SVL;  (SEQ ID NO: 487)

VSNX$^1$(fGly')X$^2$Z$^2$X$^3$Z$^3$K[A/G]L;  (SEQ ID NO: 488)

NKX$^1$(fGly')X$^2$Z$^2$X$^3$Z$^3$[ALP/GL-];  (SEQ ID NO: 489)

KAX$^1$(fGly')X$^2$Z$^2$X$^3$Z$^3$LPA;

(SEQ ID NO: 491)
NKGX$^1$(fGly')X$^2$Z$^2$X$^3$Z$^3$LP[A/S];

(SEQ ID NO: 492)
ALPX$^1$(fGly')X$^2$Z$^2$X$^3$Z$^3$AP;

(SEQ ID NO: 493)
GLPX$^1$(fGly')X$^2$Z$^2$X$^3$Z$^3$[AP/SS];

(SEQ ID NO: 494)
LPAX$^1$(fGly')X$^2$Z$^2$X$^3$Z$^3$PI;

(SEQ ID NO: 495)
LPSX$^1$(fGly')X$^2$Z$^2$X$^3$Z$^3$SI;

(SEQ ID NO: 496)
LP[AP/SS]X$^1$(fGly')X$^2$Z$^2$X$^3$Z$^3$IE;

(SEQ ID NO: 497)
TISX$^1$(fGly')X$^2$Z$^2$X$^3$Z$^3$K[A-/TK];
or (SEQ ID NO: 498)
ISKX$^1$(fGly')X$^2$Z$^2$X$^3$Z$^3$[AK-/TKG].

In some embodiments, the constant region of the Ig heavy chain polypeptide includes the amino acid sequence:

(SEQ ID NO: 499)
[-KA/SKT]KX$^1$(fGly')X$^2$Z$^2$X$^3$Z$^3$GQPR;

(SEQ ID NO: 500)
[A/T]KGX$^1$(fGly')X$^2$Z$^2$X$^3$Z$^3$QPR;

(SEQ ID NO: 501)
QPX$^1$(fGly')X$^2$Z$^2$X$^3$Z$^3$REP;

(SEQ ID NO: 502)
QPRX$^1$(fGly')X$^2$Z$^2$X$^3$Z$^3$EP;

(SEQ ID NO: 503)
REPX$^1$(fGly')X$^2$Z$^2$X$^3$Z$^3$QVY;

(SEQ ID NO: 504)
YTLX$^1$(fGly')X$^2$Z$^2$X$^3$Z$^3$PPS;

(SEQ ID NO: 505)
TLPX$^1$(fGly')X$^2$Z$^2$X$^3$Z$^3$PS[R/Q];

(SEQ ID NO: 506)
LPPX$^1$(fGly')X$^2$Z$^2$X$^3$Z$^3$S[RE/Q-];

(SEQ ID NO: 507)
PPSX$^1$(fGly')X$^2$Z$^2$X$^3$Z$^3$[RE-/RD-/QEE];

-continued (SEQ ID NO: 508)
PSRX$^1$(fGly')X$^2$Z$^2$X$^3$Z$^3$[EE/DE];

(SEQ ID NO: 509)
PSQX$^1$(fGly')X$^2$Z$^2$X$^3$Z$^3$EE;

(SEQ ID NO: 510)
[-SR/PSQ]EX$^1$(fGly')X$^2$Z$^2$X$^3$Z$^3$EM;

(SEQ ID NO: 511)
RDX$^1$(fGly')X$^2$Z$^2$X$^3$Z$^3$EL;

(SEQ ID NO: 512)
[SR/-Q]EEX$^1$(fGly')X$^2$Z$^2$X$^3$Z$^3$MT;

(SEQ ID NO: 513)
DEX$^1$(fGly')X$^2$Z$^2$X$^3$Z$^3$LTK;

(SEQ ID NO: 514)
[-M/EL]TX$^1$(fGly')X$^2$Z$^2$X$^3$Z$^3$KN;

(SEQ ID NO: 515)
[M/L]TKX$^1$(fGly')X$^2$Z$^2$X$^3$Z$^3$NQ;

(SEQ ID NO: 516)
NQX$^1$(fGly')X$^2$Z$^2$X$^3$Z$^3$VS;

(SEQ ID NO: 517)
NQVX$^1$(fGly')X$^2$Z$^2$X$^3$Z$^3$SLT;

(SEQ ID NO: 518)
TCLVKX$^1$(fGly')X$^2$Z$^2$X$^3$Z$^3$GF;

(SEQ ID NO: 519)
FYX$^1$(fGly')X$^2$Z$^2$X$^3$Z$^3$PS;

(SEQ ID NO: 520)
[A/S]VEX$^1$(fGly')X$^2$Z$^2$X$^3$Z$^3$WE;

(SEQ ID NO: 521)
WESX$^1$(fGly')X$^2$Z$^2$X$^3$Z$^3$[N/S]G;

(SEQ ID NO: 522)
ES[N/S]X$^1$(fGly')X$^2$Z$^2$X$^3$Z$^3$GQ;

(SEQ ID NO: 523)
[-SN/ESS]GX$^1$(fGly')X$^2$Z$^2$X$^3$Z$^3$QP;

(SEQ ID NO: 524)
[N/S]GQX$^1$(fGly')X$^2$Z$^2$X$^3$Z$^3$PE;

(SEQ ID NO: 525)
[N/S]GQPX$^1$(fGly')X$^2$Z$^2$X$^3$Z$^3$EN;

(SEQ ID NO: 526)
QPEX$^1$(fGly')X$^2$Z$^2$X$^3$Z$^3$NN;

(SEQ ID NO: 527)
ENX$^1$(fGly')X$^2$Z$^2$X$^3$Z$^3$NY;

(SEQ ID NO: 528)
NNX$^1$(fGly')X$^2$Z$^2$X$^3$Z$^3$Y[K/N];

(SEQ ID NO: 529)
NYX$^1$(fGly')X$^2$Z$^2$X$^3$Z$^3$[K/N]T;

(SEQ ID NO: 530)
NY[K/N]X$^1$(fGly')X$^2$Z$^2$X$^3$Z$^3$TT;

(SEQ ID NO: 531)
Y[K/N]TX$^1$(fGly')X$^2$Z$^2$X$^3$Z$^3$TP;

(SEQ ID NO: 532)
TTPX$^1$(fGly')X$^2$Z$^2$X$^3$Z$^3$P[V/M];

(SEQ ID NO: 533)
LDX$^1$(fGly')X$^2$Z$^2$X$^3$Z$^3$SD;

(SEQ ID NO: 534)
DSX$^1$(fGly')X$^2$Z$^2$X$^3$Z$^3$DG;

-continued

DSDX$^1$(fGly')X$^2$Z$^2$X$^3$Z$^3$GS; (SEQ ID NO: 535)

SDGX$^1$(fGly')X$^2$Z$^2$X$^3$Z$^3$SF; (SEQ ID NO: 536)

GSX$^1$(fGly')X$^2$Z$^2$X$^3$Z$^3$FF; (SEQ ID NO: 537)

SFX$^1$(fGly')X$^2$Z$^2$X$^3$Z$^3$FL; (SEQ ID NO: 538)

[K/R]LTX$^1$(fGly')X$^2$Z$^2$X$^3$Z$^3$VD; (SEQ ID NO: 539)

[K/R]LTVX$^1$(fGly')X$^2$Z$^2$X$^3$Z$^3$DK; (SEQ ID NO: 540)

TVDX$^1$(fGly')X$^2$Z$^2$X$^3$Z$^3$KSR; (SEQ ID NO: 541)

TVDKX$^1$(fGly')X$^2$Z$^2$X$^3$Z$^3$SR; (SEQ ID NO: 542)

DKSX$^1$(fGly')X$^2$Z$^2$X$^3$Z$^3$RW; (SEQ ID NO: 543)

KSRX$^1$(fGly')X$^2$Z$^2$X$^3$Z$^3$WQ; (SEQ ID NO: 544)

RWX$^1$(fGly')X$^2$Z$^2$X$^3$Z$^3$QQ; (SEQ ID NO: 545)

WQX$^1$(fGly')X$^2$Z$^2$X$^3$Z$^3$QG; (SEQ ID NO: 546)

[-QQ/WQE]X$^1$(fGly')X$^2$Z$^2$X$^3$Z$^3$GN; (SEQ ID NO: 547)

[Q/E]GX$^1$(fGly')X$^2$Z$^2$X$^3$Z$^3$NV; (SEQ ID NO: 548)

[GNV/-NI]X$^1$(fGly')X$^2$Z$^2$X$^3$Z$^3$FS; (SEQ ID NO: 549)

[NV/-I]FX$^1$(fGly')X$^2$Z$^2$X$^3$Z$^3$SCS; (SEQ ID NO: 550)

FSX$^1$(fGly')X$^2$Z$^2$X$^3$Z$^3$CS; (SEQ ID NO: 551)

[HY/RF]X$^1$(fGly')X$^2$Z$^2$X$^3$Z$^3$TQ; (SEQ ID NO: 552)

[HY/-F]TX$^1$(fGly')X$^2$Z$^2$X$^3$Z$^3$QK; (SEQ ID NO: 553)

[Y/F]TQX$^1$(fGly')X$^2$Z$^2$X$^3$Z$^3$KS; (SEQ ID NO: 554)

QKX$^1$(fGly')X$^2$Z$^2$X$^3$Z$^3$SLSLS; (SEQ ID NO: 555)

QKSX$^1$(fGly')X$^2$Z$^2$X$^3$Z$^3$LSLS; (SEQ ID NO: 556)

KSLX$^1$(fGly')X$^2$Z$^2$X$^3$Z$^3$SLS; (SEQ ID NO: 557)

KSLSLX$^1$(fGly')X$^2$Z$^2$X$^3$Z$^3$S; (SEQ ID NO: 558)

LSLSX$^1$(fGly')X$^2$Z$^2$X$^3$Z$^3$[P/L]; (SEQ ID NO: 559)
or

[---SP/LSLSL]X$^1$(fGly')X$^2$Z$^2$X$^3$Z$^3$G. (SEQ ID NO: 560)

Also provided herein is an antibody conjugate containing an antibody covalently bound to a payload, the antibody containing an immunoglobulin (Ig) heavy chain polypeptide including, in a constant region, an amino acid sequence of the formula: X$^1$ (fGly') x$^2$z$^2$x$^3$z$^3$, wherein fGly' is an fGly residue covalently bound to the payload; Z$^2$ is proline or alanine; Z$^3$ is an aliphatic amino acid or a basic amino acid; X$^1$ is present or absent, and when present, can be any amino acid; and X$^2$ and X$^3$ are each independently any amino acid, and wherein the constant region of the Ig heavy chain polypeptide includes the amino acid sequence:

X$^1$(fGly')X$^2$Z$^2$X$^3$Z$^3$AS; (SEQ ID NO: 370)

AX$^1$(fGly')X$^2$Z$^2$X$^3$Z$^3$STK; (SEQ ID NO: 371)

TX$^1$(fGly')X$^2$Z$^2$X$^3$Z$^3$KGP; (SEQ ID NO: 372)

KX$^1$(fGly')X$^2$Z$^2$X$^3$Z$^3$GPSVFP; (SEQ ID NO: 373)

PX$^1$(fGly')X$^2$Z$^2$X$^3$Z$^3$SVFP; (SEQ ID NO: 374)

PSX$^1$(fGly')X$^2$Z$^2$X$^3$Z$^3$VFP; (SEQ ID NO: 375)

VX$^1$(fGly')X$^2$Z$^2$X$^3$Z$^3$FPL; (SEQ ID NO: 376)

APX$^1$(fGly')X$^2$Z$^2$X$^3$Z$^3$[SSK/CSR]; (SEQ ID NO: 377)

SSX$^1$(fGly')X$^2$Z$^2$X$^3$Z$^3$KST; (SEQ ID NO: 378)

CSX$^1$(fGly')X$^2$Z$^2$X$^3$Z$^3$RS; (SEQ ID NO: 379)

[SK/-R]X$^1$(fGly')X$^2$Z$^2$X$^3$Z$^3$STS; (SEQ ID NO: 380)

KSX$^1$(fGly')X$^2$Z$^2$X$^3$Z$^3$TSGG; (SEQ ID NO: 381)

RSX$^1$(fGly')X$^2$Z$^2$X$^3$Z$^3$TS[GG/E-]; (SEQ ID NO: 382)

KSTX$^1$(fGly')X$^2$Z$^2$X$^3$Z$^3$SGG; (SEQ ID NO: 383)

RSTX$^1$(fGly')X$^2$Z$^2$X$^3$Z$^3$S[GG/E-]; (SEQ ID NO: 384)

TSX$^1$(fGly')X$^2$Z$^2$X$^3$Z$^3$[GG/ES]T; (SEQ ID NO: 385)

SGX$^1$(fGly')X$^2$Z$^2$X$^3$Z$^3$GTA; (SEQ ID NO: 386)

EX$^1$(fGly')X$^2$Z$^2$X$^3$Z$^3$STA; (SEQ ID NO: 387)

[GG/ES]X$^1$(fGly')X$^2$Z$^2$X$^3$Z$^3$TA; (SEQ ID NO: 388)

[-G/ES]TX$^1$(fGly')X$^2$Z$^2$X$^3$Z$^3$AA; (SEQ ID NO: 389)

TAX$^1$(fGly')X$^2$Z$^2$X$^3$Z$^3$ALG; (SEQ ID NO: 390)

AAX$^1$(fGly')X$^2$Z$^2$X$^3$Z$^3$LGC; (SEQ ID NO: 391)

ALX$^1$(fGly')X$^2$Z$^2$X$^3$Z$^3$GC; (SEQ ID NO: 392)

-continued (SEQ ID NO: 393)
PE$X^1$(fGly')$X^2Z^2X^3Z^3$PVT;

(SEQ ID NO: 394)
VS$X^1$(fGly')$X^2Z^2X^3Z^3$WN;

(SEQ ID NO: 395)
SW$X^1$(fGly')$X^2Z^2X^3Z^3$NSG;

(SEQ ID NO: 396)
WN$X^1$(fGly')$X^2Z^2X^3Z^3$SGA;

(SEQ ID NO: 397)
NS$X^1$(fGly')$X^2Z^2X^3Z^3$GA;

(SEQ ID NO: 398)
NSG$X^1$(fGly')$X^2Z^2X^3Z^3$ALT;

(SEQ ID NO: 399)
GA$X^1$(fGly')$X^2Z^2X^3Z^3$LTS;

(SEQ ID NO: 400)
GAL$X^1$(fGly')$X^2Z^2X^3Z^3$TS;

(SEQ ID NO: 401)
LT$X^1$(fGly')$X^2Z^2X^3Z^3$SGV;

(SEQ ID NO: 402)
LTS$X^1$(fGly')$X^2Z^2X^3Z^3$GVH;

(SEQ ID NO: 403)
LTSG$X^1$(fGly')$X^2Z^2X^3Z^3$VHT;

(SEQ ID NO: 404)
GV$X^1$(fGly')$X^2Z^2X^3Z^3$HTF;

(SEQ ID NO: 405)
VH$X^1$(fGly')$X^2Z^2X^3Z^3$TFP;

(SEQ ID NO: 406)
HT$X^1$(fGly')$X^2Z^2X^3Z^3$FPA;

(SEQ ID NO: 407)
QS$X^1$(fGly')$X^2Z^2X^3Z^3$SG;

(SEQ ID NO: 408)
QSS$X^1$(fGly')$X^2Z^2X^3Z^3$GLY;

(SEQ ID NO: 409)
SSG$X^1$(fGly')$X^2Z^2X^3Z^3$LYSL;

(SEQ ID NO: 410)
GL$X^1$(fGly')$X^2Z^2X^3Z^3$YSL;

(SEQ ID NO: 411)
LY$X^1$(fGly')$X^2Z^2X^3Z^3$SLSS;

(SEQ ID NO: 412)
SL$X^1$(fGly')$X^2Z^2X^3Z^3$SSV;

(SEQ ID NO: 413)
SSV$X^1$(fGly')$X^2Z^2X^3Z^3$VTV;

(SEQ ID NO: 414)
VV$X^1$(fGly')$X^2Z^2X^3Z^3$TVP;

(SEQ ID NO: 415)
VVT$X^1$(fGly')$X^2Z^2X^3Z^3$VP;

(SEQ ID NO: 416)
VVTV$X^1$(fGly')$X^2Z^2X^3Z^3$PSS[S/N];

(SEQ ID NO: 417)
VP$X^1$(fGly')$X^2Z^2X^3Z^3$SSS;

(SEQ ID NO: 418)
VPS$X^1$(fGly')$X^2Z^2X^3Z^3$S[SL/NF];

(SEQ ID NO: 419)
VPSS$X^1$(fGly')$X^2Z^2X^3Z^3$[SLGT/NF--];

-continued (SEQ ID NO: 420)
SSS$X^1$(fGly')$X^2Z^2X^3Z^3$LGT;

(SEQ ID NO: 421)
SSN$X^1$(fGly')$X^2Z^2X^3Z^3$FG;

(SEQ ID NO: 422)
[SSL/-NF]$X^1$(fGly')$X^2Z^2X^3Z^3$GT;

(SEQ ID NO: 423)
SLG$X^1$(fGly')$X^2Z^2X^3Z^3$T[Q/K]T;

(SEQ ID NO: 424)
FG$X^1$(fGly')$X^2Z^2X^3Z^3$TQT;

(SEQ ID NO: 425)
LGT$X^1$(fGly')$X^2Z^2X^3Z^3$[QT-/KTY];

(SEQ ID NO: 426)
FGT$X^1$(fGly')$X^2Z^2X^3Z^3$QT;

(SEQ ID NO: 427)
TQ$X^1$(fGly')$X^2Z^2X^3Z^3$TY[I/T];

(SEQ ID NO: 428)
GTK$X^1$(fGly')$X^2Z^2X^3Z^3$TYT;

(SEQ ID NO: 429)
QT$X^1$(fGly')$X^2Z^2X^3Z^3$Y[I-/TC];

(SEQ ID NO: 430)
TKT$X^1$(fGly')$X^2Z^2X^3Z^3$YTC;

(SEQ ID NO: 431)
TY$X^1$(fGly')$X^2Z^2X^3Z^3$[IC-/TCN];

(SEQ ID NO: 432)
Y[I/T]$X^1$(fGly')$X^2Z^2X^3Z^3$CN;

(SEQ ID NO: 433)
NV$X^1$(fGly')$X^2Z^2X^3Z^3$[NHK/DH-];

(SEQ ID NO: 434)
[N/D]H$X^1$(fGly')$X^2Z^2X^3Z^3$KPS;

(SEQ ID NO: 435)
HK$X^1$(fGly')$X^2Z^2X^3Z^3$PSN;

(SEQ ID NO: 436)
KP$X^1$(fGly')$X^2Z^2X^3Z^3$SNT;

(SEQ ID NO: 437)
KPS$X^1$(fGly')$X^2Z^2X^3Z^3$NTK;

(SEQ ID NO: 438)
PSN$X^1$(fGly')$X^2Z^2X^3Z^3$TKV;

(SEQ ID NO: 439)
NT$X^1$(fGly')$X^2Z^2X^3Z^3$KVD;

(SEQ ID NO: 440)
NTK$X^1$(fGly')$X^2Z^2X^3Z^3$VDK[K/T/R];

(SEQ ID NO: 441)
KV$X^1$(fGly')$X^2Z^2X^3Z^3$DK[K/T/R];

(SEQ ID NO: 442)
DK$X^1$(fGly')$X^2Z^2X^3Z^3$[K/T/R]VE;

(SEQ ID NO: 443)
VE$X^1$(fGly')$X^2Z^2X^3Z^3$PKS;

(SEQ ID NO: 444)
VEP$X^1$(fGly')$X^2Z^2X^3Z^3$KSC;

(SEQ ID NO: 445)
PK$X^1$(fGly')$X^2Z^2X^3Z^3$SCD;

(SEQ ID NO: 446)
PKS$X^1$(fGly')$X^2Z^2X^3Z^3$CD;

-continued

SCX$^1$(fGly')X$^2$Z$^2$X$^3$Z$^3$DKT; (SEQ ID NO: 447)

CDX$^1$(fGly')X$^2$Z$^2$X$^3$Z$^3$KTH; (SEQ ID NO: 448)

CDKX$^1$(fGly')X$^2$Z$^2$X$^3$Z$^3$TH; (SEQ ID NO: 449)

KTX$^1$(fGly')X$^2$Z$^2$X$^3$Z$^3$HT; (SEQ ID NO: 450)

THX$^1$(fGly')X$^2$Z$^2$X$^3$Z$^3$TCP; (SEQ ID NO: 451)

THTX$^1$(fGly')X$^2$Z$^2$X$^3$Z$^3$CPP; (SEQ ID NO: 452)

TCX$^1$(fGly')X$^2$Z$^2$X$^3$Z$^3$PPC; (SEQ ID NO: 453)

PPX$^1$(fGly')X$^2$Z$^2$X$^3$Z$^3$CP; (SEQ ID NO: 454)

PCX$^1$(fGly')X$^2$Z$^2$X$^3$Z$^3$PAPE; (SEQ ID NO: 455)

PCPX$^1$(fGly')X$^2$Z$^2$X$^3$Z$^3$AP[E/P]; (SEQ ID NO: 456)

SCPX$^1$(fGly')X$^2$Z$^2$X$^3$Z$^3$APE; (SEQ ID NO: 457)

CPAX$^1$(fGly')$^2$Z$^2$X$^3$Z$^3$P[EL/EF/PV]; (SEQ ID NO: 458)

CPAPX$^1$(fGly')X$^2$Z$^2$X$^3$Z$^3$E[L/F]L; (SEQ ID NO: 459)

CPAPX$^1$(fGly')X$^2$Z$^2$X$^3$Z$^3$PVA; (SEQ ID NO: 460)

PE[L/F]X$^1$(fGly')X$^2$Z$^2$X$^3$Z$^3$LGG; (SEQ ID NO: 461)

[L/F]LX$^1$(fGly')X$^2$Z$^2$X$^3$Z$^3$GG; (SEQ ID NO: 462)

[LG/VA]GX$^1$(fGly')X$^2$Z$^2$X$^3$Z$^3$PSV; (SEQ ID NO: 463)

[G/A]GPX$^1$(fGly')X$^2$Z$^2$X$^3$Z$^3$SVF; (SEQ ID NO: 464)

ISX$^1$(fGly')X$^2$Z$^2$X$^3$Z$^3$RT; (SEQ ID NO: 465)

ISRX$^1$(fGly')X$^2$Z$^2$X$^3$Z$^3$TPE; (SEQ ID NO: 466)

RTX$^1$(fGly')X$^2$Z$^2$X$^3$Z$^3$PEVT; (SEQ ID NO: 467)

DVX$^1$(fGly')X$^2$Z$^2$X$^3$Z$^3$S[H--/QED]; (SEQ ID NO: 468)

DVSX$^1$(fGly')X$^2$Z$^2$X$^3$Z$^3$[H/Q]ED; (SEQ ID NO: 469)

[-SH/VSQ]X$^1$(fGly')X$^2$Z$^2$X$^3$Z$^3$ED; (SEQ ID NO: 470)

[H/Q]EX$^1$(fGly')X$^2$Z$^2$X$^3$Z$^3$DP; (SEQ ID NO: 471)

EDX$^1$(fGly')X$^2$Z$^2$X$^3$Z$^3$PEV; (SEQ ID NO: 472)

DPX$^1$(fGly')X$^2$Z$^2$X$^3$Z$^3$EV[K/Q]; (SEQ ID NO: 473)

EVKX$^1$(fGly')X$^2$Z$^2$X$^3$Z$^3$FN; (SEQ ID NO: 474)

EVQX$^1$(fGly')X$^2$Z$^2$X$^3$Z$^3$F[NM/K-]; (SEQ ID NO: 475)

GVEX$^1$(fGly')X$^2$Z$^2$X$^3$Z$^3$VHN; (SEQ ID NO: 476)

VEVX$^1$(fGly')X$^2$Z$^2$X$^3$Z$^3$HNA; (SEQ ID NO: 477)

EVHX$^1$(fGly')X$^2$Z$^2$X$^3$Z$^3$NA; (SEQ ID NO: 478)

HNX$^1$(fGly')X$^2$Z$^2$X$^3$Z$^3$AKT; (SEQ ID NO: 479)

NAX$^1$(fGly')X$^2$Z$^2$X$^3$Z$^3$KTKP; (SEQ ID NO: 480)

AKX$^1$(fGly')X$^2$Z$^2$X$^3$Z$^3$TKP; (SEQ ID NO: 481)

EQX$^1$(fGly')X$^2$Z$^2$X$^3$Z$^3$[YNS/FN-]; (SEQ ID NO: 482)

NSTX$^1$(fGly')X$^2$Z$^2$X$^3$Z$^3$[Y/F]R; (SEQ ID NO: 483)

ST[Y/F]X$^1$(fGly')X$^2$Z$^2$X$^3$Z$^3$RV; (SEQ ID NO: 484)

[Y/F]RX$^1$(fGly')X$^2$Z$^2$X$^3$Z$^3$VVS; (SEQ ID NO: 485)

[Y/F]RVX$^1$(fGly')X$^2$Z$^2$X$^3$Z$^3$VSV; (SEQ ID NO: 486)

RVVX$^1$(fGly')X$^2$Z$^2$X$^3$Z$^3$SVL; (SEQ ID NO: 487)

VSNX$^1$(fGly')X$^2$Z$^2$X$^3$Z$^3$K[A/G]L; (SEQ ID NO: 488)

NKX$^1$(fGly')X$^2$Z$^2$X$^3$Z$^3$[ALP/GL-]; (SEQ ID NO: 489)

KAX$^1$(fGly')X$^2$Z$^2$X$^3$Z$^3$LPA; (SEQ ID NO: 490)

NKGX$^1$(fGly')X$^2$Z$^2$X$^3$Z$^3$LP[A/S]; (SEQ ID NO: 491)

ALPX$^1$(fGly')X$^2$Z$^2$X$^3$Z$^3$AP; (SEQ ID NO: 492)

GLPX$^1$(fGly')X$^2$Z$^2$X$^3$Z$^3$[AP/SS]; (SEQ ID NO: 493)

LPAX$^1$(fGly')X$^2$Z$^2$X$^3$Z$^3$PI; (SEQ ID NO: 494)

LPSX$^1$(fGly')X$^2$Z$^2$X$^3$Z$^3$SI; (SEQ ID NO: 495)

LP[AP/SS]X$^1$(fGly')X$^2$Z$^2$X$^3$Z$^3$IE; (SEQ ID NO: 496)

TISX$^1$(fGly')X$^2$Z$^2$X$^3$Z$^3$K[A-/TK]; (SEQ ID NO: 497)

ISKX$^1$(fGly')X$^2$Z$^2$X$^3$Z$^3$[AK-/TKG]; (SEQ ID NO: 498)

[-KA/SKT]KX$^1$(fGly')X$^2$Z$^2$X$^3$Z$^3$GQPR; (SEQ ID NO: 499)

[A/T]KGX$^1$(fGly')X$^2$Z$^2$X$^3$Z$^3$QPR; (SEQ ID NO: 500)

-continued (SEQ ID NO: 501)
$QPX^1(fGly')X^2Z^2X^3Z^3$REP;

(SEQ ID NO: 502)
$QPRX^1(fGly')X^2Z^2X^3Z^3$EP;

(SEQ ID NO: 503)
$REPX^1(fGly')X^2Z^2X^3Z^3$QVY;

(SEQ ID NO: 504)
$YTLX^1(fGly')X^2Z^2X^3Z^3$PPS;

(SEQ ID NO: 505)
$TLPX^1(fGly')X^2Z^2X^3Z^3$PS[R/Q];

(SEQ ID NO: 506)
$LPPX^1(fGly')X^2Z^2X^3Z^3$S[RE/Q-];

(SEQ ID NO: 507)
$PPSX^1(fGly')X^2Z^2X^3Z^3$[RE-/RD-/QEE];

(SEQ ID NO: 508)
$PSRX^1(fGly')X^2Z^2X^3Z^3$[EE/DE];

(SEQ ID NO: 509)
$PSQX^1(fGly')X^2Z^2X^3Z^3$EE;

(SEQ ID NO: 510)
[-SR/PSQ]$EX^1(fGly')X^2Z^2X^3Z^3$EM;

(SEQ ID NO: 511)
$RDX^1(fGly')X^2Z^2X^3Z^3$EL;

(SEQ ID NO: 512)
[SR/-Q]$EEX^1(fGly')X^2Z^2X^3Z^3$MT;

(SEQ ID NO: 513)
$DEX^1(fGly')X^2Z^2X^3Z^3$LTK;

(SEQ ID NO: 514)
[-M/EL]$TX^1(fGly')X^2Z^2X^3Z^3$KN;

(SEQ ID NO: 515)
[M/L]$TKX^1(fGly')X^2Z^2X^3Z^3$NQ;

(SEQ ID NO: 516)
$NQX^1(fGly')X^2Z^2X^3Z^3$VS;

(SEQ ID NO: 517)
$NQVX^1(fGly')X^2Z^2X^3Z^3$SLT;

(SEQ ID NO: 518)
$TCLVKX^1(fGly')X^2Z^2X^3Z^3$GF;

(SEQ ID NO: 519)
$FYX^1(fGly')X^2Z^2X^3Z^3$PS;

(SEQ ID NO: 520)
[A/S]$VEX^1(fGly')X^2Z^2X^3Z^3$WE;

(SEQ ID NO: 521)
$WESX^1(fGly')X^2Z^2X^3Z^3$[N/S]G;

(SEQ ID NO: 522)
ES[N/S]$X^1(fGly')X^2Z^2X^3Z^3$GQ;

(SEQ ID NO: 523)
[-SN/ESS]$GX^1(fGly')X^2Z^2X^3Z^3$QP;

(SEQ ID NO: 524)
[N/S]$GQX^1(fGly')X^2Z^2X^3Z^3$PE;

(SEQ ID NO: 525)
[N/S]$GQPX^1(fGly')X^2Z^2X^3Z^3$EN;

(SEQ ID NO: 526)
$QPEX^1(fGly')X^2Z^2X^3Z^3$NN;

(SEQ ID NO: 527)
$ENX^1(fGly')X^2Z^2X^3Z^3$NY;

-continued (SEQ ID NO: 528)
$NNX^1(fGly')X^2Z^2X^3Z^3$Y[K/N];

(SEQ ID NO: 529)
$NYX^1(fGly')X^2Z^2X^3Z^3$[K/N]T;

(SEQ ID NO: 530)
NY[K/N]$X^1(fGly')X^2Z^2X^3Z^3$TT;

(SEQ ID NO: 531)
Y[K/N]$TX^1(fGly')X^2Z^2X^3Z^3$TP;

(SEQ ID NO: 532)
$TTPX^1(fGly')X^2Z^2X^3Z^3$P[V/M];

(SEQ ID NO: 533)
$LDX^1(fGly')X^2Z^2X^3Z^3$SD;

(SEQ ID NO: 534)
$DSX^1(fGly')X^2Z^2X^3Z^3$DG;

(SEQ ID NO: 535)
$DSDX^1(fGly')X^2Z^2X^3Z^3$GS;

(SEQ ID NO: 536)
$SDGX^1(fGly')X^2Z^2X^3Z^3$SF;

(SEQ ID NO: 537)
$GSX^1(fGly')X^2Z^2X^3Z^3$FF;

(SEQ ID NO: 538)
$SFX^1(fGly')X^2Z^2X^3Z^3$FL;

(SEQ ID NO: 539)
[K/R]$LTX^1(fGly')X^2Z^2X^3Z^3$VD;

(SEQ ID NO: 540)
[K/R]$LTVX^1(fGly')X^2Z^2X^3Z^3$DK;

(SEQ ID NO: 541)
$TVDX^1(fGly')X^2Z^2X^3Z^3$KSR;

(SEQ ID NO: 542)
$TVDKX^1(fGly')X^2Z^2X^3Z^3$SR;

(SEQ ID NO: 543)
$DKSX^1(fGly')X^2Z^2X^3Z^3$RW;

(SEQ ID NO: 544)
$KSRX^1(fGly')X^2Z^2X^3Z^3$WQ;

(SEQ ID NO: 545)
$RWX^1(fGly')X^2Z^2X^3Z^3$QQ;

(SEQ ID NO: 546)
$WQX^1(fGly')X^2Z^2X^3Z^3$QG;

(SEQ ID NO: 547)
[-QQ/WQE]$X^1(fGly')X^2Z^2X^3Z^3$GN;

(SEQ ID NO: 548)
[Q/E]$GX^1(fGly')X^2Z^2X^3Z^3$NV;

(SEQ ID NO: 549)
[GNV/-NI]$XL(fGly')X^2Z^2X^3Z^3$FS;

(SEQ ID NO: 550)
[NV/-I]$FX^1(fGly')X^2Z^2X^3Z^3$SCS;

(SEQ ID NO: 551)
$FSX^1(fGly')X^2Z^2X^3Z^3$CS;

(SEQ ID NO: 552)
[HY/RF]$X^1(fGly')X^2Z^2X^3Z^3$TQ;

(SEQ ID NO: 553)
[HY/-F]$TX^1(fGly')X^2Z^2X^3Z^3$QK;

(SEQ ID NO: 554)
[Y/F]$TQX^1(fGly')X^2Z^2X^3Z^3$KS;

QKX¹(fGly')X²Z²X³Z³SLSLS; (SEQ ID NO: 555)

QKSX¹(fGly')X²Z²X³Z³LSLS; (SEQ ID NO: 556)

KSLX¹(fGly')X²Z²X³Z³SLS; (SEQ ID NO: 557)

KSLSLX¹(fGly')X²Z²X³Z³S; (SEQ ID NO: 558)

LSLSX¹(fGly')X²Z²X³Z³[P/L]; (SEQ ID NO: 559)
or

[---SP/LSLSL]X¹(fGly')X²Z²X³Z³G. (SEQ ID NO: 560)

Also provided herein is a recombinant nucleic acid containing a nucleotide sequence encoding a heavy chain constant region of the antibody of the composition of any embodiment, wherein $Z^1$ is cysteine or serine. In some embodiments, the nucleotide sequence encodes the heavy chain containing a variable region and the constant region of the antibody.

Also provided herein is a recombinant expression vector containing the nucleic acid of any embodiment, wherein the heavy chain constant region-encoding nucleotide sequence is operably linked to a promoter. In some embodiments, the recombinant expression vector includes a nucleotide sequence encoding an Ig light chain polypeptide.

Provided herein is a host cell genetically modified to express an antibody of the composition of any embodiment, wherein $Z^1$ is cysteine, serine or fGly. In some embodiments, the host cell is genetically modified to express a formylglycine generating enzyme (FGE), in a manner sufficient to convert an Ig heavy chain polypeptide of the antibody into an fGly-modified Ig heavy chain polypeptide. In some embodiments, the host cell is a mammalian cell, yeast cell, insect cell or *E. coli*.

Also provided is a method of producing an antibody conjugate, including: combining, in a reaction mixture: the composition of any embodiment containing an fGly-modified antibody; and a reactive partner comprising a payload and an aldehyde-reactive group, under conditions sufficient for the aldehyde-reactive group to react with an aldehyde group of the fGly residue of the fGly-modified antibody, thereby conjugating the payload to the fGly residue via a covalent linkage to generate an antibody conjugate; and isolating the antibody conjugate from the reaction mixture. In some embodiments, the aldehyde-reactive group is selected from the group: a hydrazine, hydrazide, aminooxy, semicarbazide, hydrazinyl-indole, hydrazinyl-imidazole, hydrazinyl-pyrrole, hydrazinyl-furan and a pyrazalinone group. In some embodiments, the reactive partner includes a linking group covalently linking the aldehyde-reactive group with the payload. In some embodiments, the linking group includes a 4-aminopiperidine derivative (4AP). Also provided herein is an antibody conjugate produced by any of the above method.

Provided herein is a formulation containing: the composition of any embodiment containing an antibody conjugate, or an antibody conjugate of any embodiment; and a pharmaceutically acceptable excipient.

Also provided is a method of treating an individual for cancer, including administering to an individual a therapeutically effective amount of the composition of any embodiment containing an antibody conjugate, or an antibody conjugate of any embodiment.

Further aspects of the present disclosure are now described.

BRIEF DESCRIPTION OF THE DRAWINGS

FIGS. 2A and 2B is a graph showing the percentage of antibody monomer for an antigen-specific antibody modified with a sulfatase motif inserted adjacent and N-terminal to the indicated position, as defined relative to SEQ ID NO:1, in the constant region ($C_H1$ or hinge domain) of its Ig heavy chain amino acid sequence, and further modified to include a formylglycine (fGly) residue in the sulfatase motif, according to embodiments of the present disclosure.

FIGS. 9A and 9B is a graph showing the drug-to-antibody ratio (DAR) for an antigen-specific antibody conjugated to a hydrophobic payload, where the antibody was modified with a sulfatase motif inserted adjacent and N-terminal to the indicated position, as defined relative to SEQ ID NO:1, in the constant region ($C_H3$ domain) of its Ig heavy chain amino acid sequence, according to embodiments of the present disclosure.

FIG. 11 shows Table 5 showing properties of antibody conjugates having a tag inserted at the indicated positions, according to embodiments of the present disclosure. ND: not determined.

FIG. 12 shows Table 6 showing properties of antibody conjugates having a tag inserted at the indicated positions, according to embodiments of the present disclosure. ND: not determined.

FIG. 13 shows an alignment of human IgG heavy chain constant region sequences.

FIG. 14 shows the amino acid sequences of human IgG1, IgG2, IgG3, and IgG4 heavy chain constant regions.

FIG. 15 shows Table 7 showing amino acid sequences of human IgG1 heavy chain constant region tagged with a sulfatase motif (underlined) in the $C_H1$ region, according to embodiments of the present disclosure.

FIG. 16 shows Table 8 showing amino acid sequences of human IgG1 heavy chain constant region tagged with a sulfatase motif (underlined) in the hinge region, according to embodiments of the present disclosure.

FIG. 17 shows Table 9 showing amino acid sequences of human IgG1 heavy chain constant region tagged with a sulfatase motif (underlined) in the $C_H2$ region, according to embodiments of the present disclosure.

FIG. 18 shows Table 10 showing amino acid sequences of human IgG1 heavy chain constant region tagged with a sulfatase motif (underlined) in the $C_H3$ region, according to embodiments of the present disclosure.

DEFINITIONS

Figure 1A:
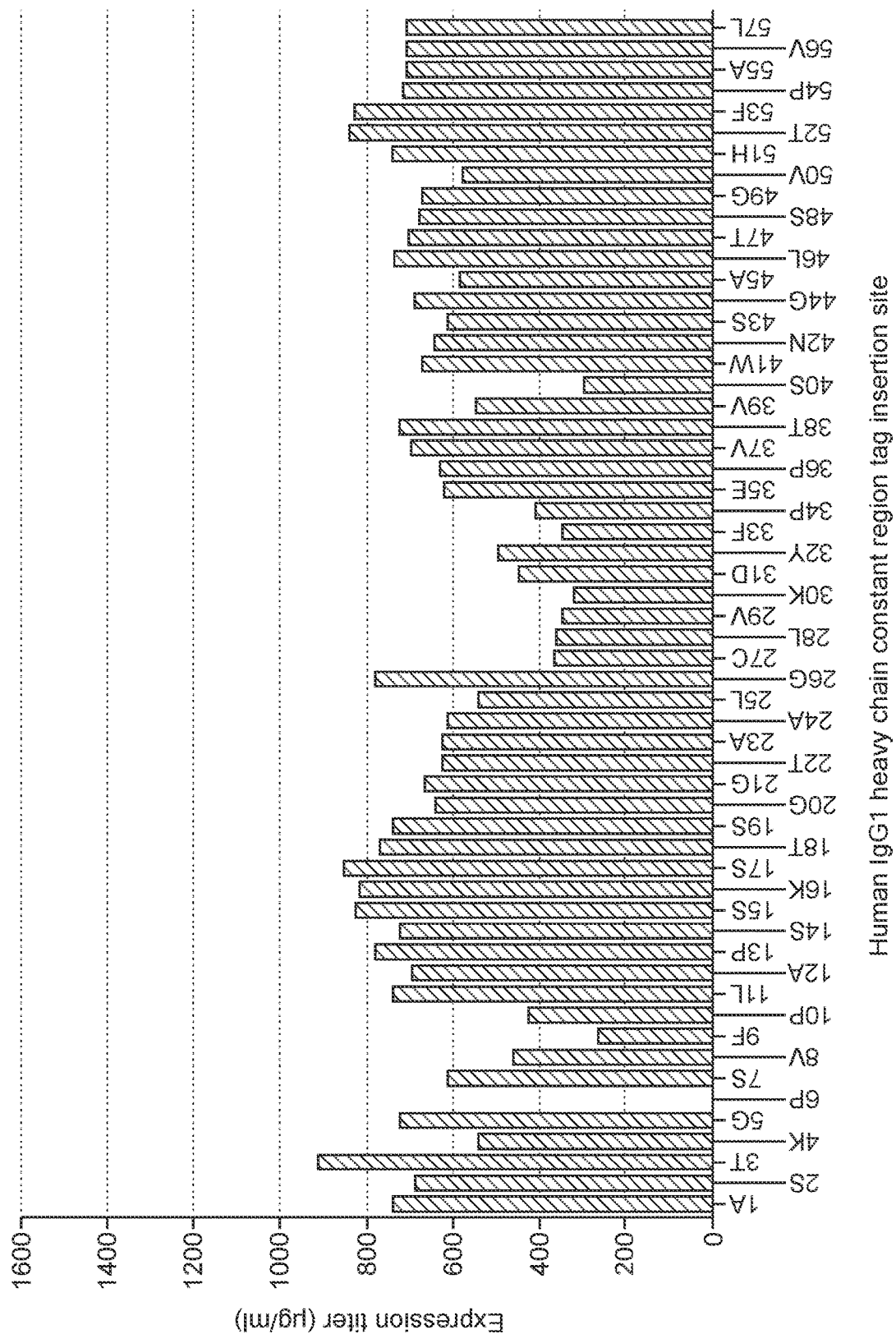
FIGS. 1A and 1B is a graph showing the expression titer (y-axis) of an antigen-specific antibody modified with a sulfatase motif insertion adjacent and N-terminal to the indicated position, as defined relative to SEQ ID NO:1, in the constant region ($C_H1$ or hinge domain) of its immunoglobulin (Ig) heavy chain amino acid sequence, according to embodiments of the present disclosure. The sulfatase motif is inserted immediately before the amino acid position indicated.
Figure 1B:
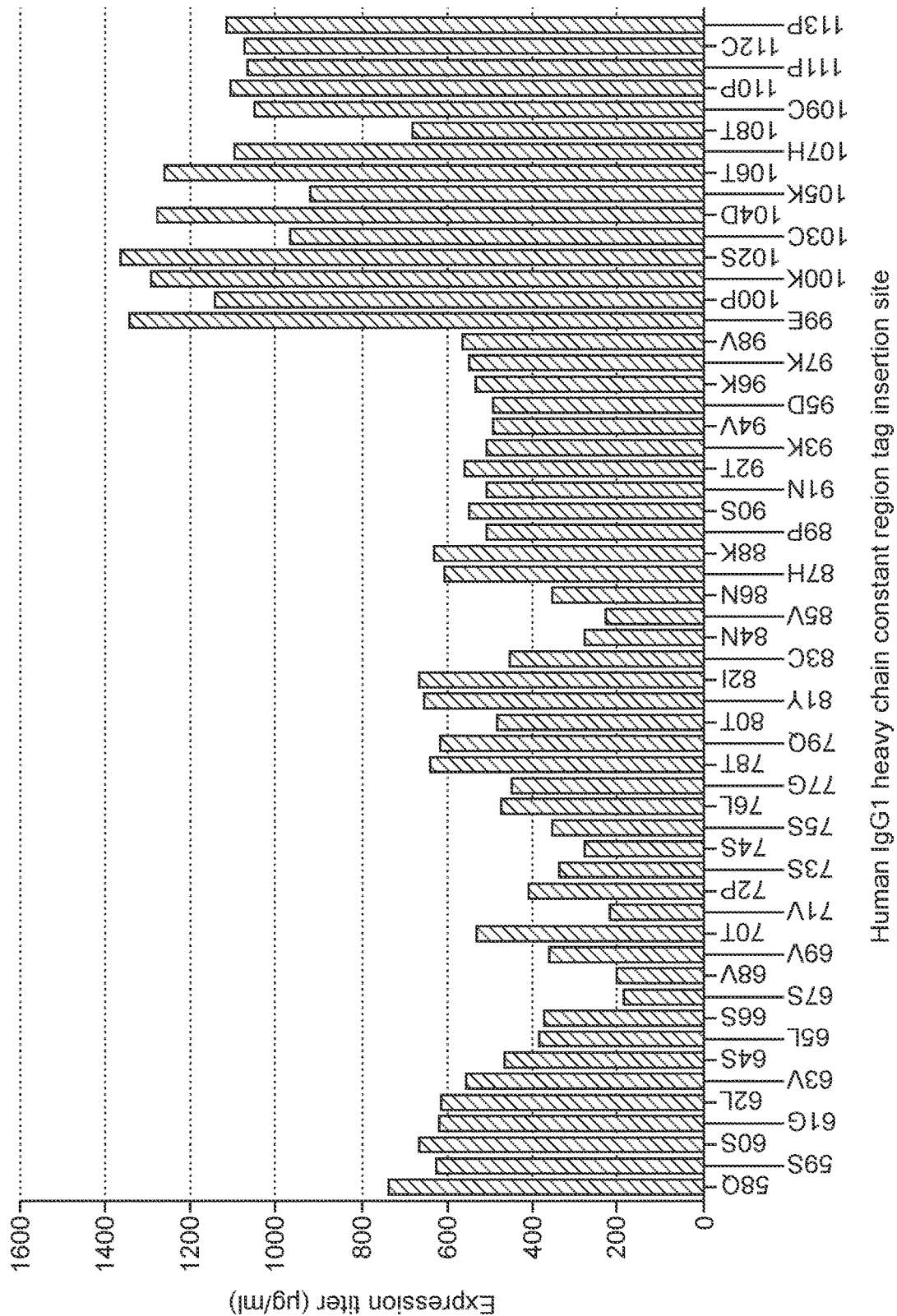
Figure 2B:
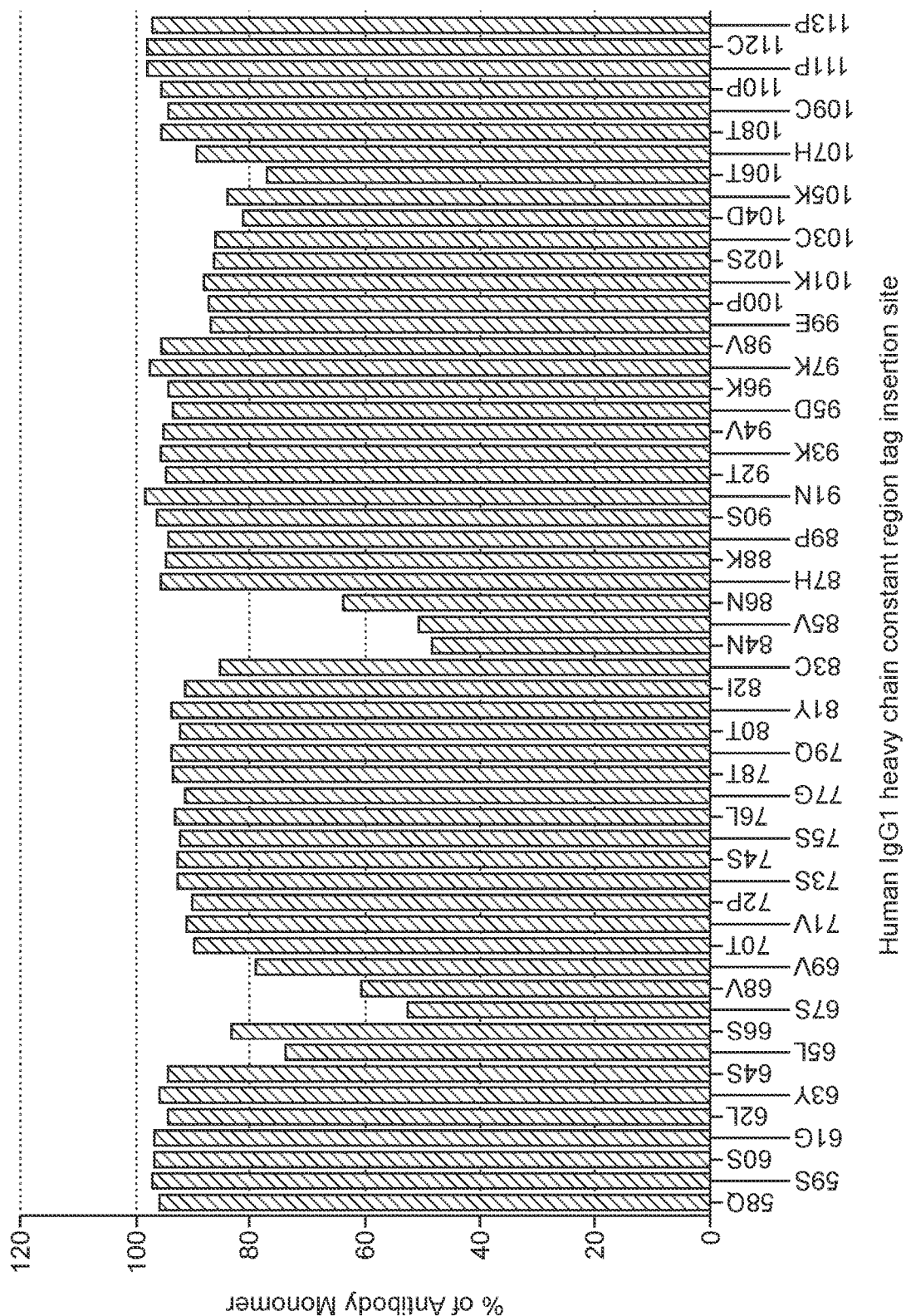
Figure 3A:
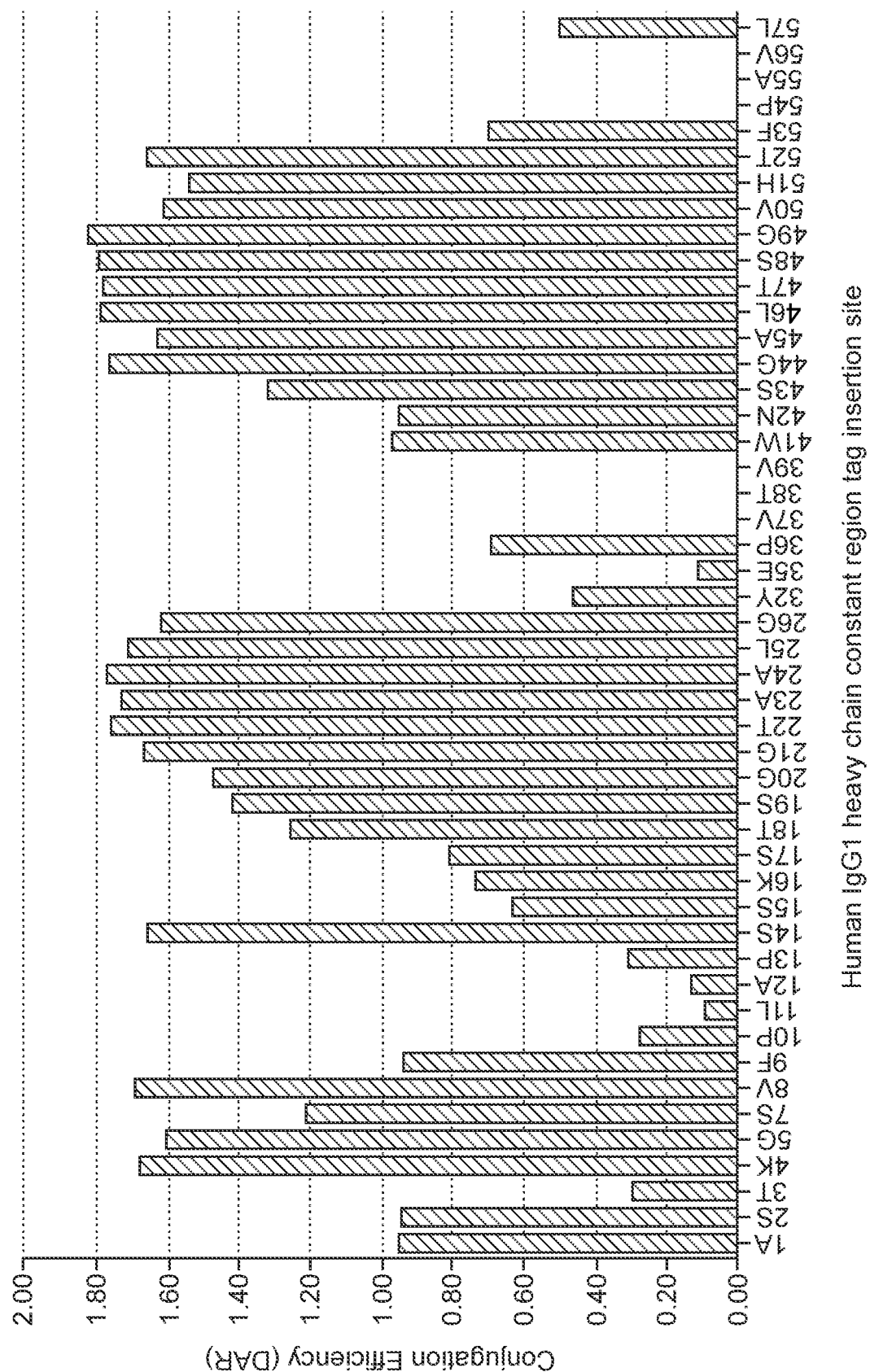
FIGS. 3A and 3B is a graph showing the drug-to-antibody ratio (DAR) for an antigen-specific antibody conjugated to a hydrophobic payload, where the antibody was modified with a sulfatase motif inserted adjacent and N-terminal to the indicated position, as defined relative to SEQ ID NO:1, in the constant region ($C_H1$ or hinge domain) of its Ig heavy chain amino acid sequence, according to embodiments of the present disclosure.
Figure 3B:
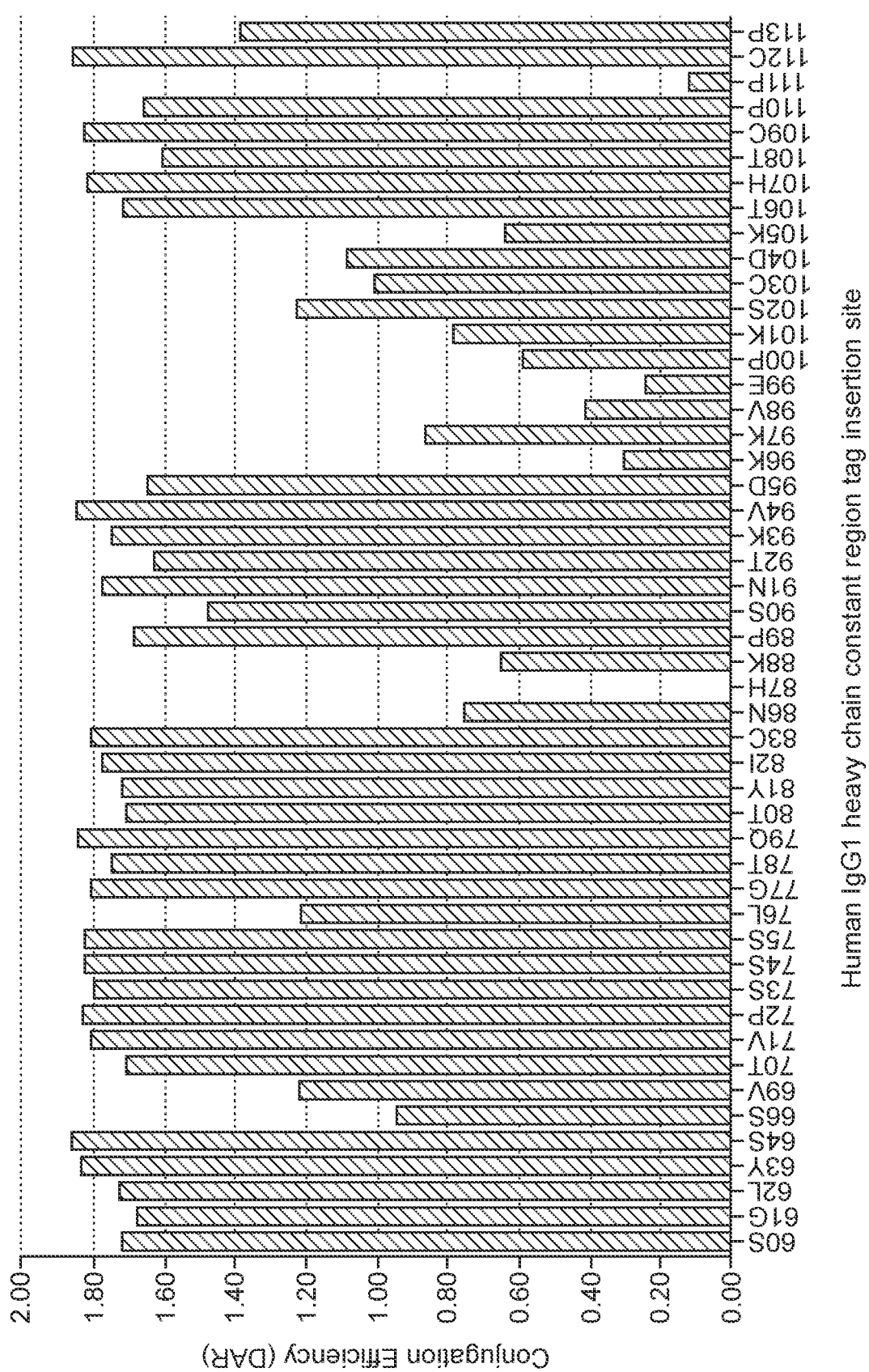
Figure 4A:
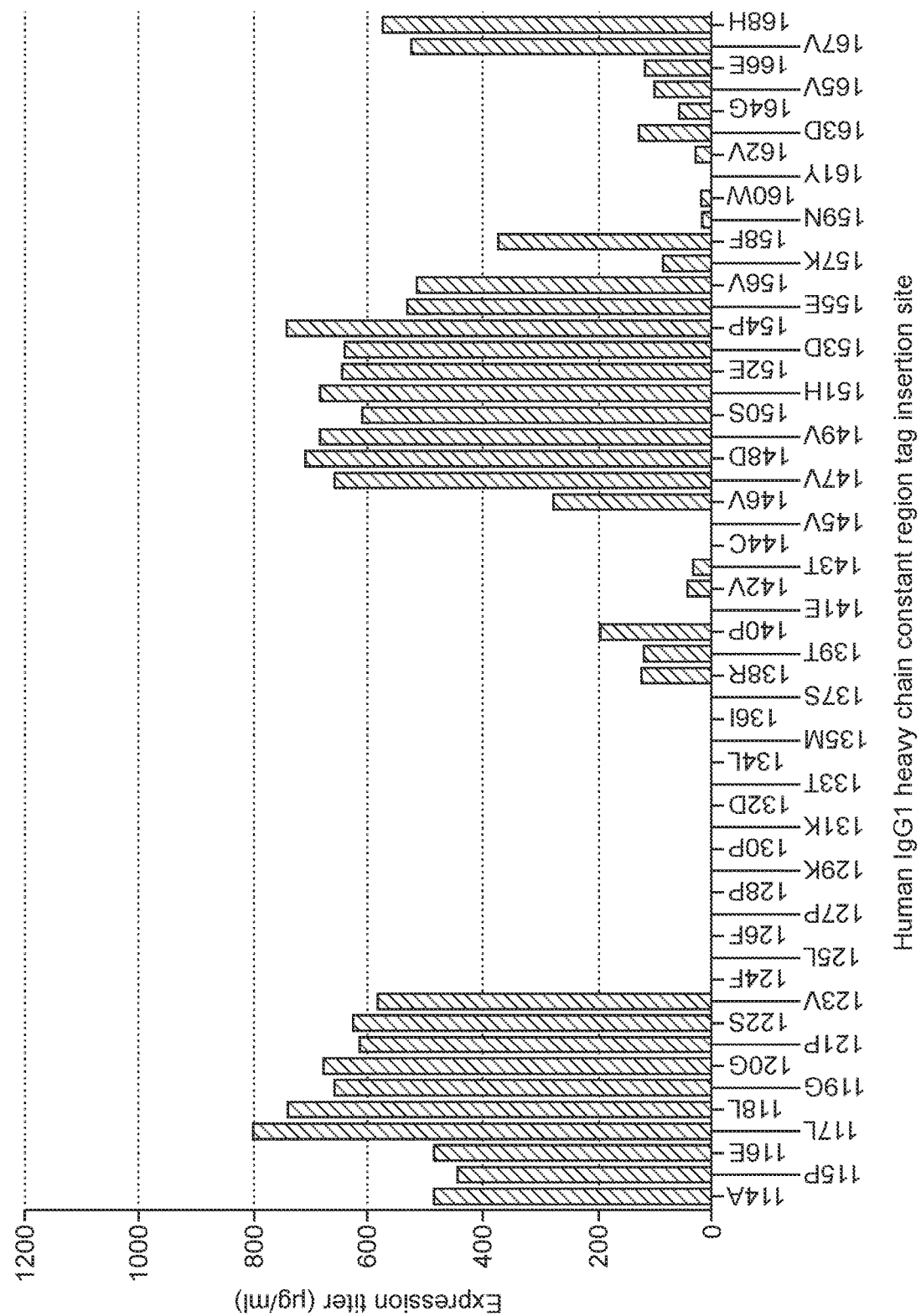
FIGS. 4A and 4B is a graph showing the expression titer (y-axis) of an antigen-specific antibody modified with a sulfatase motif insertion adjacent and N-terminal to the indicated position, as defined relative to SEQ ID NO:1, in the constant region ($C_H2$ domain) of its Ig heavy chain amino acid sequence, according to embodiments of the present disclosure. The sulfatase motif is inserted immediately before the amino acid position indicated.
Figure 4B:
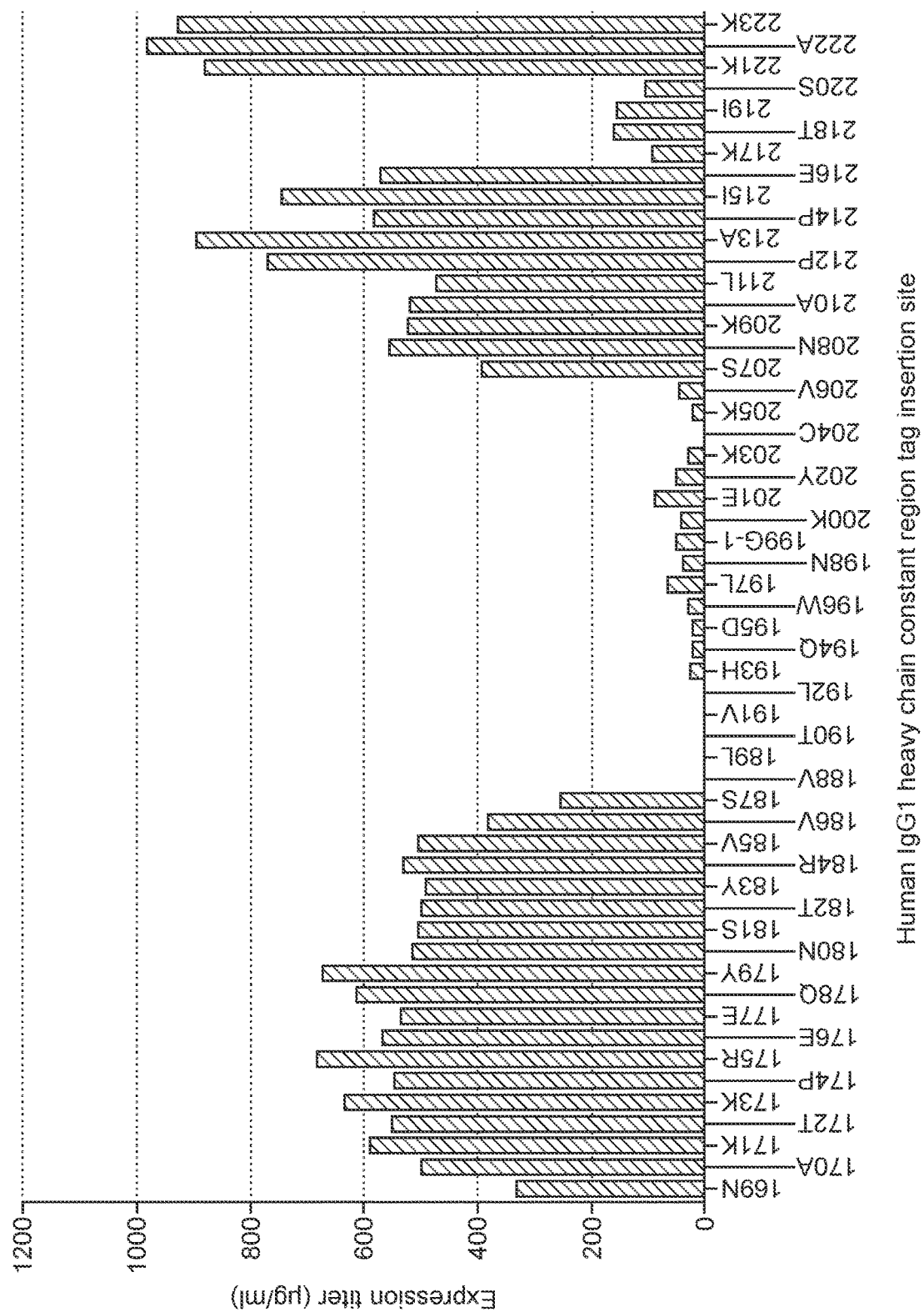
Figure 5A:
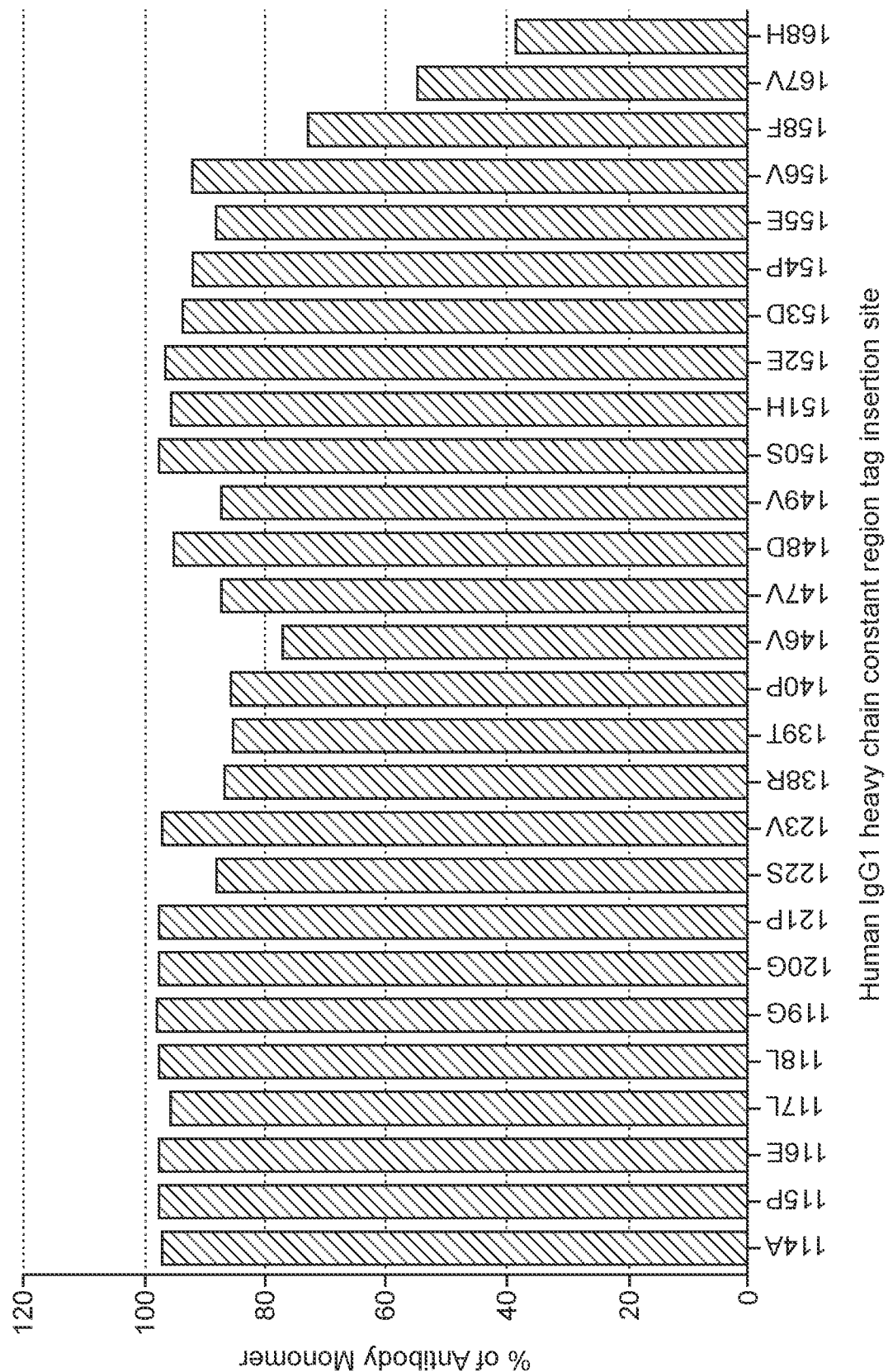
FIGS. 5A and 5B is a graph showing the percentage of antibody monomer for an antigen-specific antibody modified with a sulfatase motif inserted adjacent and N-terminal to the indicated position, as defined relative to SEQ ID NO:1, in the constant region ($C_H2$ domain) of its Ig heavy chain amino acid sequence, and further modified to include a formylglycine (fGly) residue in the sulfatase motif, according to embodiments of the present disclosure.
Figure 5B:
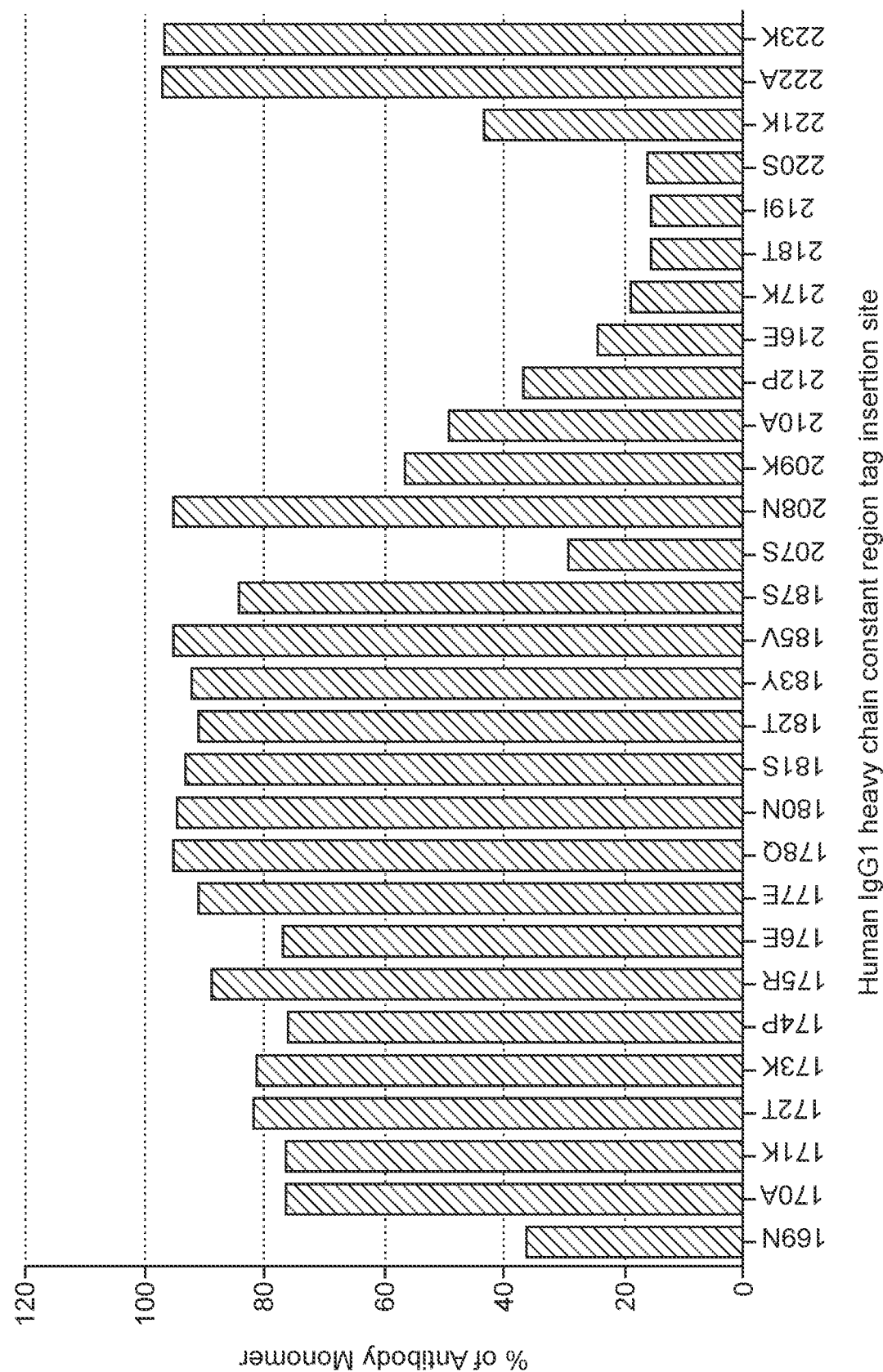
Figure 6A:
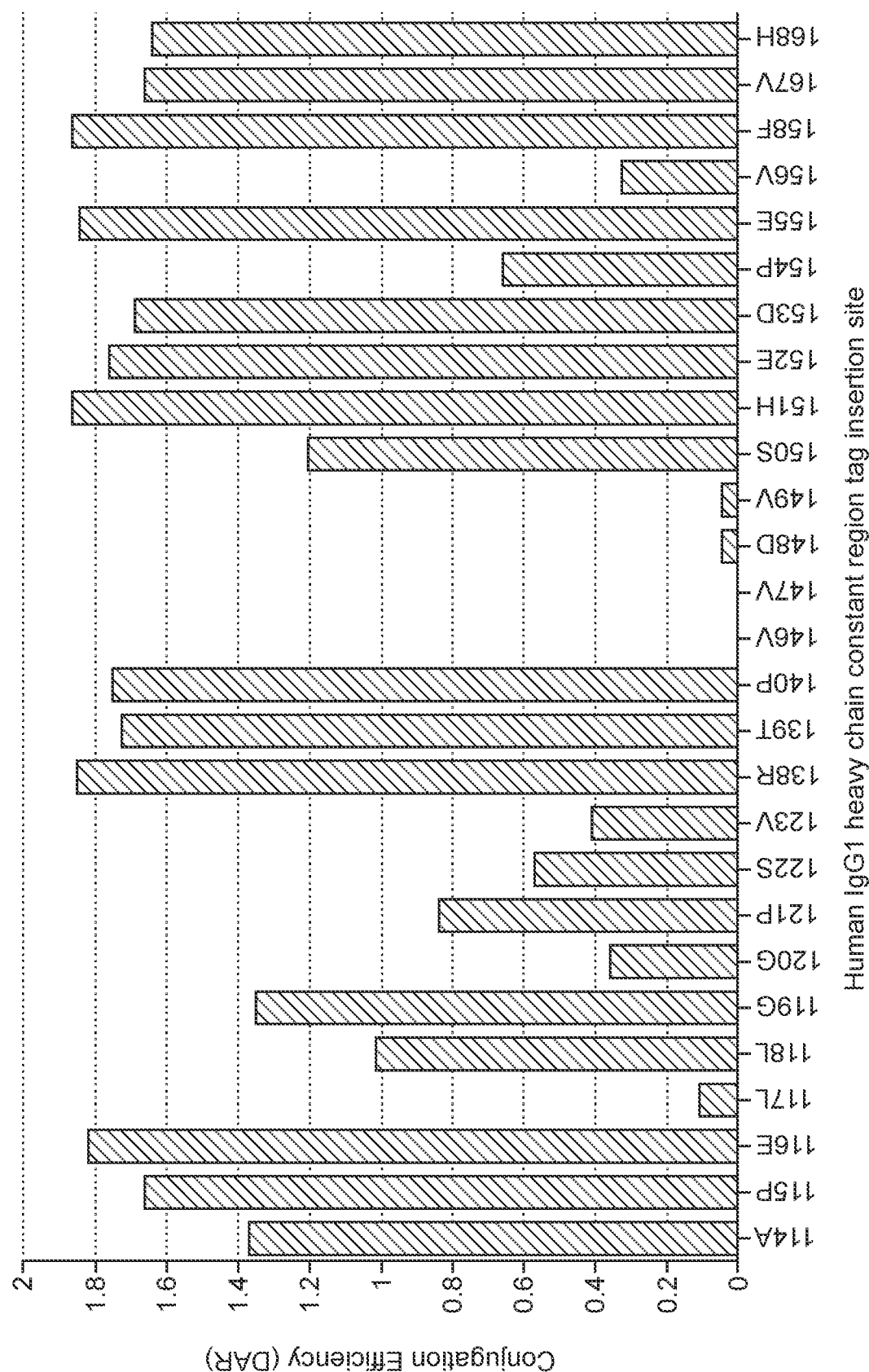
FIGS. 6A and 6B is a graph showing the drug-to-antibody ratio (DAR) for an antigen-specific antibody conjugated to a hydrophobic payload, where the antibody was modified with a sulfatase motif inserted adjacent and N-terminal to the indicated position, as defined relative to SEQ ID NO:1, in the constant region ($C_H2$ domain) of its Ig heavy chain amino acid sequence, according to embodiments of the present disclosure.
Figure 6B:
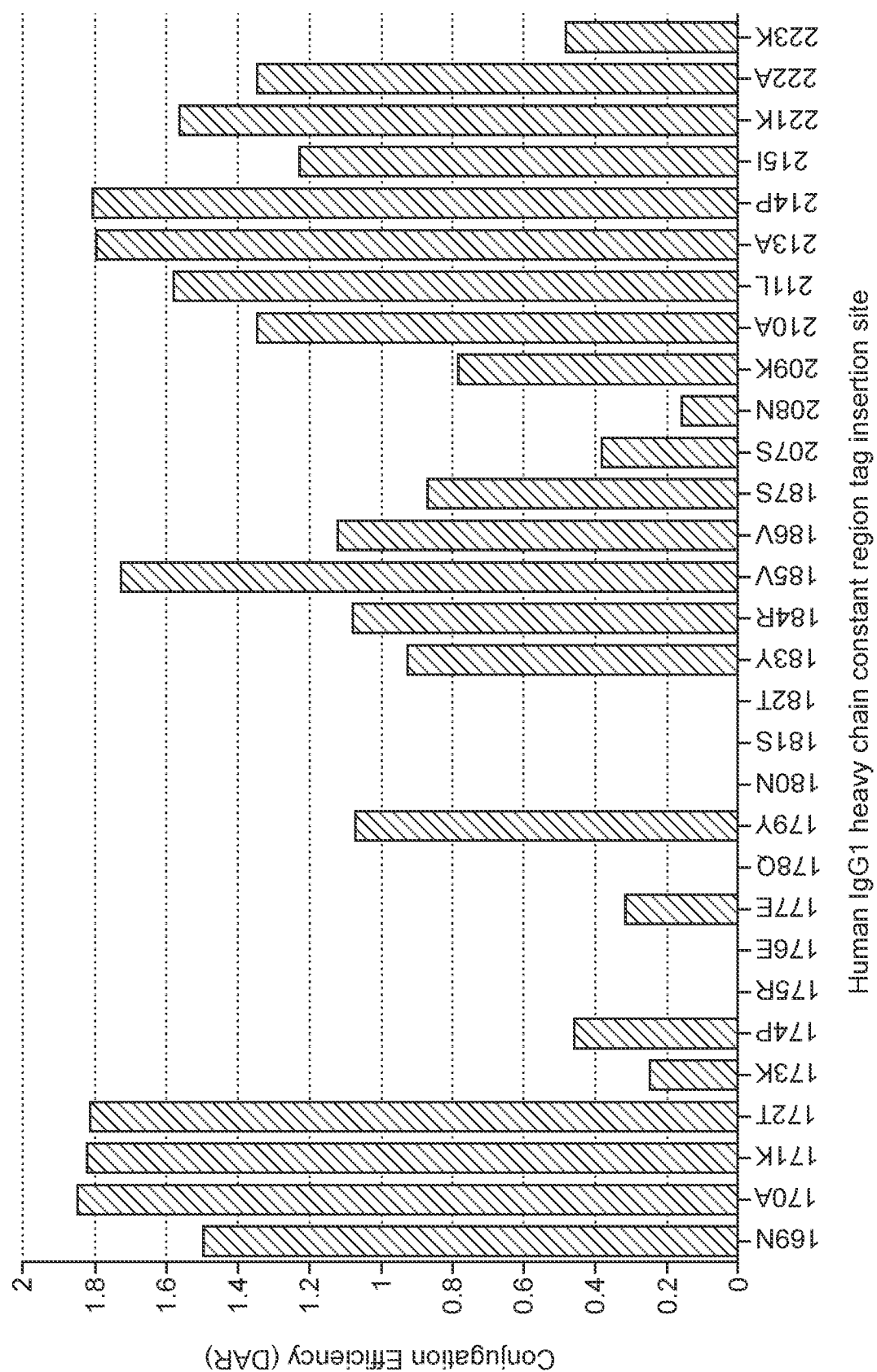
Figure 7A:
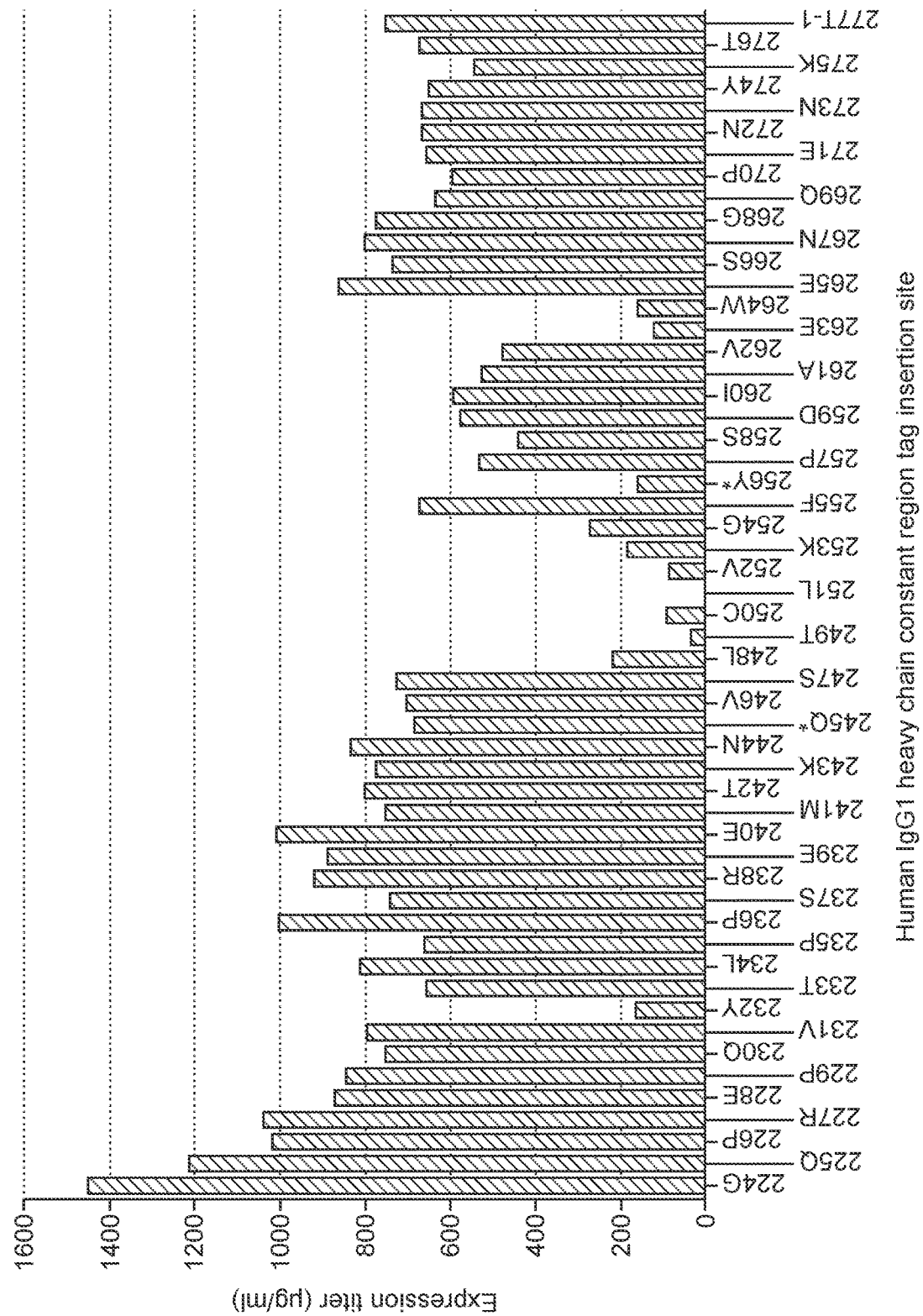
FIGS. 7A and 7B is a graph showing the expression titer (y-axis) of an antigen-specific antibody modified with a sulfatase motif insertion adjacent and N-terminal to the indicated position, as defined relative to SEQ ID NO:1, in the constant region ($C_H3$ domain) of its Ig heavy chain amino acid sequence, according to embodiments of the present disclosure. The sulfatase motif is inserted immediately before the amino acid position indicated.
Figure 7B:
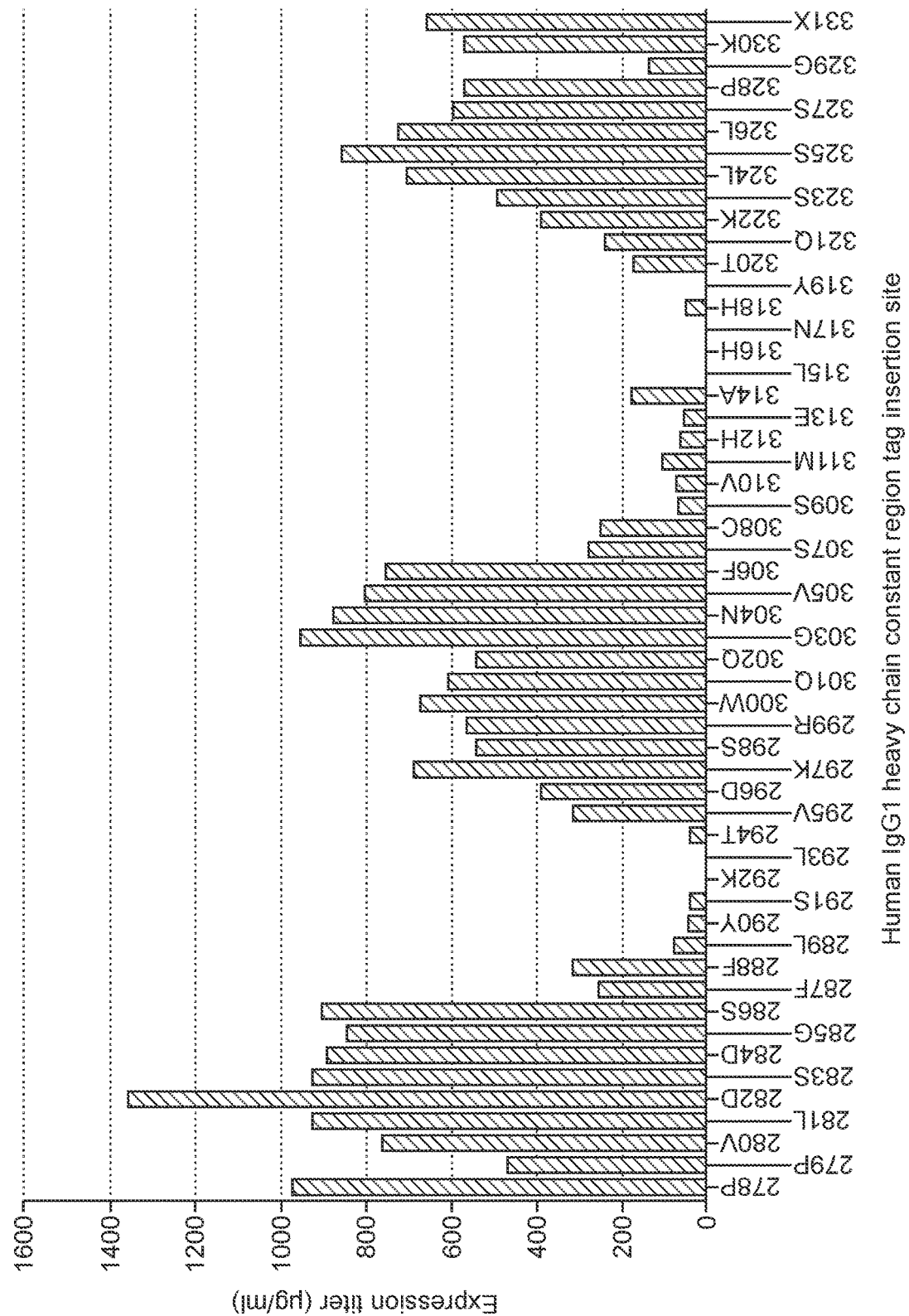
Figure 8A:
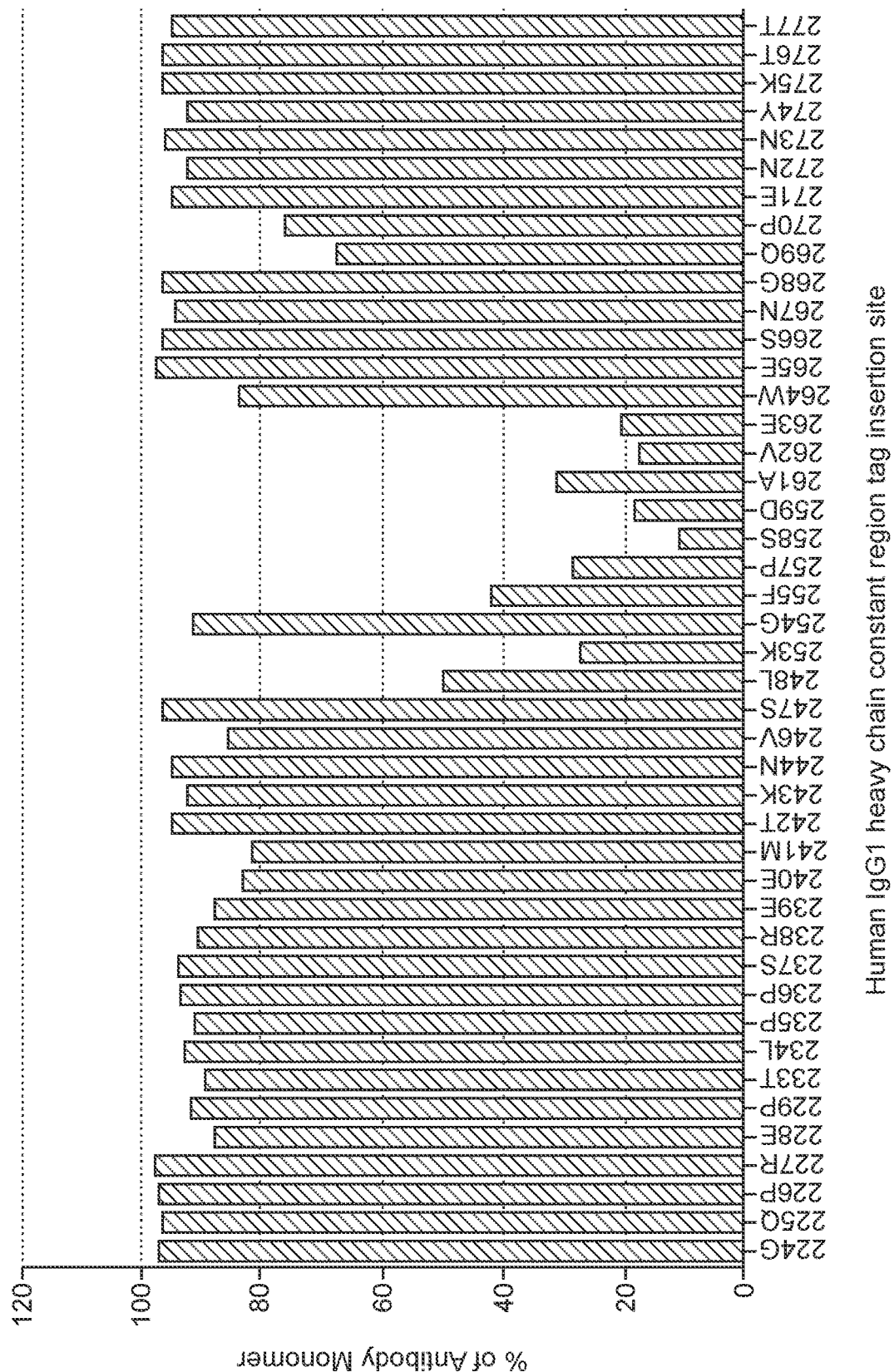
FIGS. 8A and 8B is a graph showing the percentage of antibody monomer for an antigen-specific antibody modified with a sulfatase motif inserted adjacent and N-terminal to the indicated position, as defined relative to SEQ ID NO:1, in the constant region ($C_H3$ domain) of its Ig heavy chain amino acid sequence, and further modified to include a formylglycine (fGly) residue in the sulfatase motif, according to embodiments of the present disclosure.
Figure 8B:
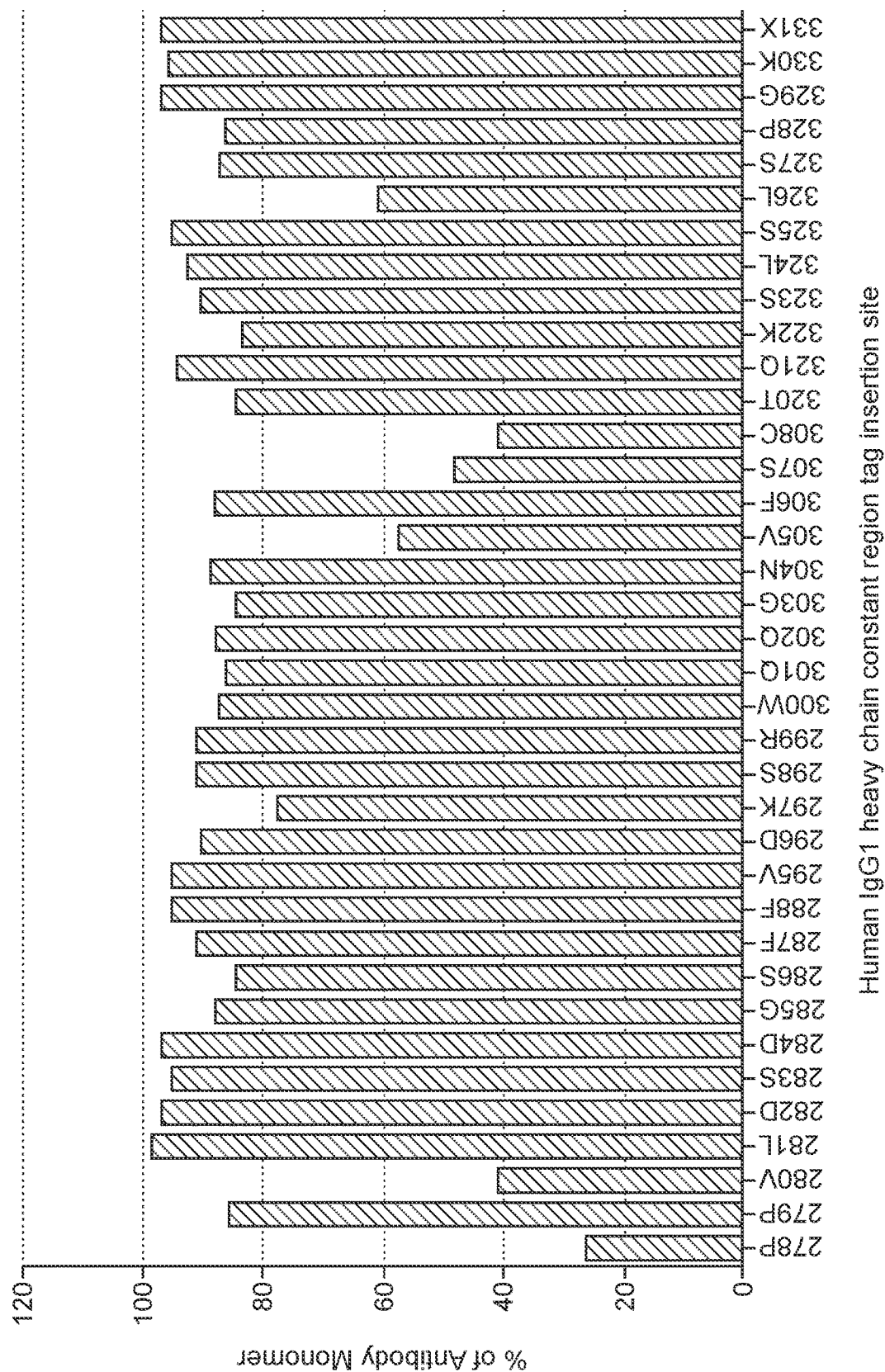
Figure 9B:
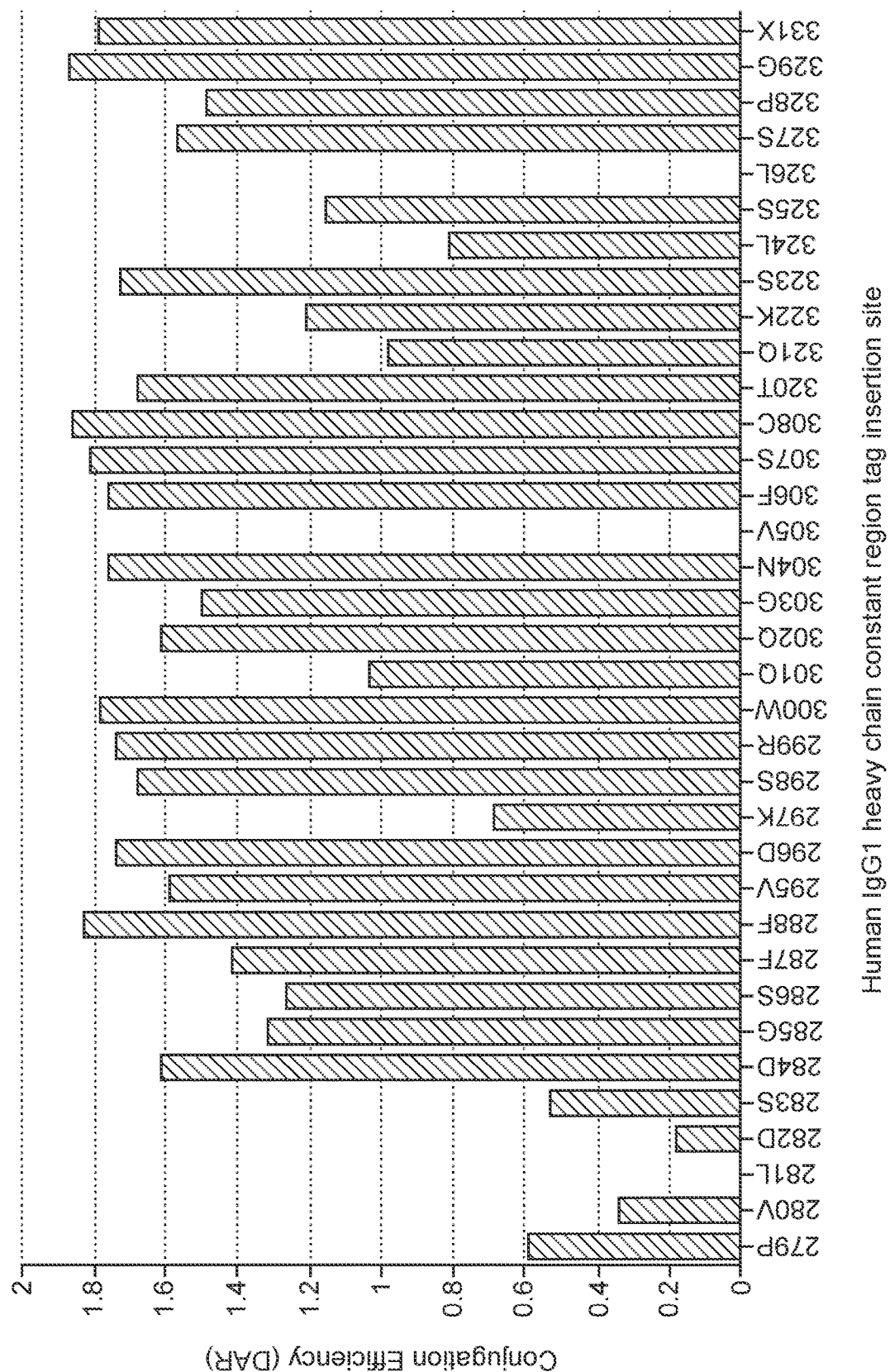

The term "about" as used herein when referring to a measurable value such as an amount, a temporal duration, and the like, is meant to encompass variations of ±20% or ±10%, more preferably ±5%, even more preferably ±1%, and still more preferably ±0.1% from the specified value, as such variations are typical of measurements characterizing the disclosed compositions or appropriate to perform the disclosed methods.

The terms "polypeptide," "peptide," and "protein" are used interchangeably herein to refer to a polymeric form of amino acids of any length. Unless specifically indicated otherwise, "polypeptide," "peptide," and "protein" can include genetically coded and non-coded amino acids, chemically or biochemically modified or derivatized amino acids, and polypeptides having modified peptide backbones. The term includes fusion proteins, including, but not limited to, fusion proteins with a heterologous amino acid sequence, fusions with heterologous and homologous leader sequences, proteins which contain at least one N-terminal methionine residue (e.g., to facilitate production in a recombinant bacterial host cell); immunologically tagged proteins; and the like.

"Native amino acid sequence" or "parent amino acid sequence" are used interchangeably herein in the context of an immunoglobulin to refer to the amino acid sequence of the immunoglobulin prior to modification to include a heterologous aldehyde tag.

The term "antibody" is used in the broadest sense and includes monoclonal antibodies, and multispecific antibodies (e.g., bispecific antibodies), humanized antibodies, chimeric antibodies, and antigen-binding antibody fragments (e.g., Fab fragments). A target antigen can have one or more binding sites, also called epitopes, recognized by complementarity determining regions (CDRs) formed by one or more variable regions of an antibody.

"Bind" as used in reference to an antibody may refer to the physical interaction between an antibody and a target (e.g., an antigen) characterized by an affinity ($K_D$) value of $10^{-6}$ M or less, e.g., $10^{-7}$ M or less, $10^{-8}$ M or less, $10^{-9}$ M or less, $10^{-10}$ M or less, including $10^{-11}$ M or less. A lower $K_D$ value corresponds to a higher binding affinity (i.e., stronger binding) so that a $K_D$ value of $10^{-7}$ M indicates a higher binding affinity than a $K_D$ value of $10^{-6}$ M.

"Immunoglobulin polypeptide" as used herein refers to a polypeptide comprising at least a constant region of a light chain polypeptide or at least a constant region of a heavy chain polypeptide.

An immunoglobulin light or heavy chain polypeptide variable region is composed of a framework region (FR) interrupted by three hypervariable regions, also called "complementarity determining regions" or "CDRs". The extent of the framework region and CDRs have been defined (see, "Sequences of Proteins of Immunological Interest," E. Kabat et al., U.S. Department of Health and Human Services, 1991). The framework region of an antibody, that is the combined framework regions of the constituent light and heavy chains, serves to position and align the CDRs. The CDRs are primarily responsible for binding to an epitope of an antigen. An immunoglobuline light chain may have a structure schematically represented, from N- to C-termini, as: FR1-CDR1-FR2-CDR2-FR3-CDR3-FR4-$C_L$, where CDR1, CDR2 and CDR3 are hypervariable regions that interrupt the framework region into four (FR1, FR2, FR3 and FR4) and $C_L$ is the constant region. An immunoglobulin heavy chain may have a structure schematically represented, from N- to C-termini, as: FR1-CDR1-FR2-CDR2-FR3-CDR3-FR4-$C_H1$-H—$C_H2$-$C_H3$, where CDR1, CDR2 and CDR3 are hypervariable regions that interrupt the framework region into four (FR1, FR2, FR3 and FR4), $C_H1$, $C_H2$ and $C_H3$ are constant regions and H is a hinge region.

The term "natural antibody" refers to an antibody in which the heavy and light chains of the antibody have been made and paired by the immune system of a multi-cellular organism. Spleen, lymph nodes, bone marrow and serum are examples of tissues that produce natural antibodies. For example, the antibodies produced by the antibody producing cells isolated from a first animal immunized with an antigen are natural antibodies.

A "parent Ig polypeptide" is a polypeptide comprising an amino acid sequence which lacks a tagged constant region as described herein. The parent polypeptide may comprise a native sequence constant region, or may comprise a constant region with pre-existing amino acid sequence modifications (such as additions, deletions and/or substitutions).

In the context of an Ig polypeptide, the term "constant region" is well understood in the art, and refers to a C-terminal region of an Ig heavy chain, or an Ig light chain. An Ig heavy chain constant region includes CH1, CH2, and CH3 domains (and CH4 domains, where the heavy chain is a µ or an ɛ heavy chain). In a native Ig heavy chain, the CH1, CH2, CH3 (and, if present, CH4) domains begin immediately after (C-terminal to) the heavy chain variable ($V_H$) region, and are each from about 100 amino acids to about 130 amino acids in length. In a native Ig light chain, the constant region begins begin immediately after (C-terminal to) the light chain variable ($V_L$) region, and is about 100 amino acids to 120 amino acids in length.

In some embodiments, a "functional Fc region" possesses an "effector function" of a native sequence Fc region. Exemplary "effector functions" include C1q binding; complement dependent cytotoxicity; Fc receptor binding; antibody-dependent cell-mediated cytotoxicity (ADCC); phagocytosis; down-regulation of cell surface receptors (e.g. B cell receptor; BCR), etc. Such effector functions generally require the Fc region to be combined with a binding domain (e.g. an antibody variable domain) and can be assessed using various assays that are well known in the art.

Antibody-dependent cell-mediated cytotoxicity" and "ADCC" refer to a cell-mediated reaction in which nonspecific cytotoxic cells that express FcRs (e.g. Natural Killer (NK) cells, neutrophils, and macrophages) recognize bound antibody on a target cell and subsequently cause lysis of the target cell. The primary cells for mediating ADCC, NK cells, express FcγRIII only, whereas monocytes express FcγRI, FcγRII and FcγRIII The terms "Fc receptor" or "FcR" are used to describe a receptor that binds to the Fc region of an antibody.

The term "humanized antibody" or "humanized immunoglobulin" refers to a non-human (e.g., mouse or rabbit) antibody containing one or more amino acids (in a framework region, a constant region or a CDR, for example) that have been substituted with a correspondingly positioned amino acid from a human antibody. In general, humanized antibodies produce a reduced immune response in a human host, as compared to a non-humanized version of the same antibody. Antibodies can be humanized using a variety of techniques known in the art including, for example, CDR-grafting, veneering or resurfacing, and chain shuffling. In certain embodiments, framework substitutions are identified by modeling of the interactions of the CDR and framework residues to identify framework residues important for antigen binding and sequence comparison to identify unusual framework residues at particular positions.

The term "chimeric antibodies" refer to antibodies whose light and heavy chain genes have been constructed, typically by genetic engineering, from antibody variable and constant region genes belonging to different species. For example, the variable segments of the genes from a mouse monoclonal antibody may be joined to human constant segments, such as gamma 1 and gamma 3. An example of a therapeutic chimeric antibody is a hybrid protein composed of the variable or antigen-binding domain from a mouse antibody and the constant or effector domain from a human antibody, although domains from other mammalian species may be used.

By "genetically-encodable" as used in reference to an amino acid sequence of polypeptide, peptide or protein means that the amino acid sequence is composed of amino acid residues that are capable of production by transcription and translation of a nucleic acid encoding the amino acid sequence, where transcription and/or translation may occur in a cell or in a cell-free in vitro transcription/translation system.

The term "control sequences" refers to DNA sequences that facilitate expression of an operably linked coding sequence in a particular expression system, e.g. mammalian cell, bacterial cell, cell-free synthesis, etc. The control sequences that are suitable for prokaryote systems, for example, include a promoter, optionally an operator sequence, and a ribosome binding site. Eukaryotic cell systems may utilize promoters, polyadenylation signals, and enhancers.

A nucleic acid is "operably linked" when it is placed into a functional relationship with another nucleic acid sequence. For example, DNA for a presequence or secretory leader is operably linked to DNA for a polypeptide if it is expressed as a preprotein that participates in the secretion of the polypeptide; a promoter or enhancer is operably linked to a coding sequence if it affects the transcription of the sequence; or a ribosome binding site is operably linked to a coding sequence if it is positioned so as to facilitate the initiation of translation. Generally, "operably linked" means that the DNA sequences being linked are contiguous, and, in the case of a secretory leader, contiguous and in reading frame. Linking is accomplished by ligation or through amplification reactions. Synthetic oligonucleotide adaptors or linkers may be used for linking sequences in accordance with conventional practice.

The term "expression cassette" as used herein refers to a segment of nucleic acid, usually DNA, that can be inserted into a nucleic acid (e.g., by use of restriction sites compatible with ligation into a construct of interest or by homologous recombination into a construct of interest or into a host cell genome). In general, the nucleic acid segment comprises a polynucleotide that encodes a polypeptide of interest (e.g., a tagged Ig protein), and the cassette and restriction sites are designed to facilitate insertion of the cassette in the proper reading frame for transcription and translation. Expression cassettes can also comprise elements that facilitate expression of a polynucleotide encoding a polypeptide of interest in a host cell. These elements may include, but are not limited to: a promoter, a minimal promoter, an enhancer, a response element, a terminator sequence, a polyadenylation sequence, and the like.

As used herein the term "isolated" is meant to describe a compound of interest that is in an environment different from that in which the compound naturally occurs. "Isolated" is meant to include compounds that are within samples that are substantially enriched for the compound of interest and/or in which the compound of interest is partially or substantially purified.

As used herein, the term "substantially purified" refers to a compound that is removed from its natural environment and is at least 60% free, at least 75% free, at least 80% free, at least 85% free, at least 90% free, at least 95% free, at least 98% free, or more than 98% free, from other components with which it is naturally associated.

The term "physiological conditions" is meant to encompass those conditions compatible with living cells, e.g., predominantly aqueous conditions of a temperature, pH, salinity, etc. that are compatible with living cells.

"N-terminus" refers to the terminal amino acid residue of a polypeptide having a free amine group, which amine group in non-N-terminus amino acid residues normally forms part of the covalent backbone of the polypeptide.

"C-terminus" refers to the terminal amino acid residue of a polypeptide having a free carboxyl group, which carboxyl group in non-C-terminus amino acid residues normally forms part of the covalent backbone of the polypeptide.

By "internal site" as used in referenced to a polypeptide or an amino acid sequence of a polypeptide means a region of the polypeptide that is not at the N-terminus or at the C-terminus.

As used herein, the terms "treat," "treatment," "treating," and the like, refer to obtaining a desired pharmacologic and/or physiologic effect. The effect may be prophylactic in terms of completely or partially preventing a disease or symptom thereof and/or may be therapeutic in terms of a partial or complete cure for a disease and/or adverse affect attributable to the disease. "Treatment," as used herein, covers any treatment of a disease in a mammal, particularly in a human, and includes: (a) preventing the disease from occurring in a subject which may be predisposed to the disease but has not yet been diagnosed as having it; (b) inhibiting the disease, i.e., arresting its development; and (c) relieving the disease, e.g., causing regression of the disease, e.g., to completely or partially remove symptoms of the disease.

A "therapeutically effective amount" refers to an amount effective, at dosages and for periods of time necessary, to achieve the desired therapeutic result. A therapeutically effective amount of a therapeutic agent may vary according to factors such as the disease state, age, sex, and weight of the individual, and the ability of the therapeutic agent to elicit a desired response in the individual. A therapeutically effective amount is also one in which any toxic or detrimental effects of the therapeutic agent are outweighed by the therapeutically beneficial effects.

By "tag" is meant an amino acid sequence that contains an amino acid sequence motif found in sulfatases (hereinafter "sulfatase motif"), which amino acid sequence motif is capable of being converted, by action of a formylglycine generating enzyme (FGE), to contain a 2-formylglycine residue (referred to herein as "fGly"). The fGly residue generated by an FGE is often referred to in the literature as a "formylglycine". Stated differently, the term "tag" is used herein to refer to an amino acid sequence comprising an "unconverted" sulfatase motif (i.e., a sulfatase motif in which the cysteine or serine residues has not been converted to fGly by an FGE, but is capable of being converted). The sulfatase motif may be exchangeable with "FGE substrate motif". A "tagged" polypeptide contains an amino acid sequence motif, e.g., a sulfatase motif, that can be converted by an FGE to contain fGly.

By "conversion" as used in the context of action of a formylglycine generating enzyme (FGE) on a sulfatase motif refers to biochemical modification of a cysteine or serine residue in a sulfatase motif to a formylglycine (fGly) residue (e.g., Cys to fGly, or Ser to fGly).

"Aldehyde tag" or "ald-tag" as used herein, may refer to a tag that contains a sulfatase motif, which has been converted, by action of an FGE, to contain fGly. A converted tag refers to an amino acid sequence comprising a "converted" sulfatase motif (i.e., a sulfatase motif in which the cysteine or the serine residue has been converted to fGly by action of an FGE). An "aldehyde tagged" polypeptide contains an amino acid sequence motif, e.g., a sulfatase motif, that has been converted by an FGE to contain fGly.

By "reactive partner" is meant a molecule or molecular moiety that specifically reacts with another reactive partner to produce a reaction product. Exemplary reactive partners include a cysteine or serine of sulfatase motif and an FGE, which react to form a reaction product of a converted aldehyde tag containing an fGly in lieu of cysteine or serine in the motif. Other exemplary reactive partners include an aldehyde of a formylglycine (fGly) residue of a converted aldehyde tag and an "aldehyde-reactive reactive partner", which comprises an aldehyde-reactive group and a moiety of interest (i.e., a payload, e.g., drug), and which reacts to form a reaction product of a modified aldehyde tagged polypeptide having the payload (e.g., drug) conjugated to the fGly-modified polypeptide via an fGly residue.

By "conjugate" is meant a first moiety that is stably associated with a second moiety. By "stably associated" is meant that a moiety is bound to another moiety or structure under standard conditions. In certain embodiments, the first and second moieties are bound to each other through one or more covalent bonds. The first or the second moiety of a conjugate may be referred to as a "payload."

Before the present disclosure is further described, it is to be understood that the disclosed subject matter is not limited to particular embodiments described, as such may, of course, vary. It is also to be understood that the terminology used herein is for the purpose of describing particular embodiments only, and is not intended to be limiting, since the scope of the present disclosure will be limited only by the appended claims.

Where a range of values is provided, it is understood that each intervening value, to the tenth of the unit of the lower limit unless the context clearly dictates otherwise, between the upper and lower limit of that range and any other stated or intervening value in that stated range, is encompassed within the disclosed subject matter. The upper and lower limits of these smaller ranges may independently be included in the smaller ranges, and are also encompassed within the disclosed subject matter, subject to any specifically excluded limit in the stated range. Where the stated range includes one or both of the limits, ranges excluding either or both of those included limits are also included in the disclosed subject matter.

Unless defined otherwise, all technical and scientific terms used herein have the same meaning as commonly understood by one of ordinary skill in the art to which the disclosed subject matter belongs. Although any methods and materials similar or equivalent to those described herein can also be used in the practice or testing of the disclosed subject matter, the preferred methods and materials are now described. All publications mentioned herein are incorporated herein by reference to disclose and describe the methods and/or materials in connection with which the publications are cited.

It must be noted that as used herein and in the appended claims, the singular forms "a," "an," and "the" include plural referents unless the context clearly dictates otherwise. Thus, for example, reference to "a antibody" includes a plurality of such antibodies and reference to "the antigen" includes reference to one or more antigens and equivalents thereof known to those skilled in the art, and so forth. It is further noted that the claims may be drafted to exclude any optional element. As such, this statement is intended to serve as antecedent basis for use of such exclusive terminology as "solely," "only" and the like in connection with the recitation of claim elements, or use of a "negative" limitation.

It is appreciated that certain features of the disclosed subject matter, which are, for clarity, described in the context of separate embodiments, may also be provided in combination in a single embodiment. Conversely, various features of the disclosed subject matter, which are, for brevity, described in the context of a single embodiment, may also be provided separately or in any suitable sub-combination. All combinations of the embodiments pertaining to the disclosure are specifically embraced by the disclosed subject matter and are disclosed herein just as if each and every combination was individually and explicitly disclosed. In addition, all sub-combinations of the various embodiments and elements thereof are also specifically embraced by the present disclosure and are disclosed herein just as if each and every such sub-combination was individually and explicitly disclosed herein.

The publications discussed herein are provided solely for their disclosure prior to the filing date of the present application. Nothing herein is to be construed as an admission that the disclosed subject matter is not entitled to antedate such publication by virtue of prior invention. Further, the dates of publication provided may be different from the actual publication dates which may need to be independently confirmed.

DETAILED DESCRIPTION

As summarized above, an antibody that includes a tag, e.g., a tag containing a sulfatase motif, in an immunoglobulin (Ig) heavy chain polypeptide is disclosed. The tag includes a substrate motif for a formylglycine-generating enzyme (FGE), where FGE can convert (oxidize) a serine or cysteine residue in the substrate motif to a 2-formylglycine residue (fGly), thereby generating an fGcly-modified antibody. An fGly-modified antibody can further react with an aldehyde-reactive partner to generate an antibody conjugate, where a moiety of interest (i.e., a payload, e.g., drug) is bound covalently and site-specifically to the heavy chain via the fGly.

The tagged antibodies, conjugates, compositions and methods of the present disclosure exploit a naturally-occurring, genetically-encodable sulfatase motif for use as a tag, referred to herein as a "tag", to direct site-specific modification of an Ig polypeptide. The sulfatase motif of the tag, which motif is based on a motif found in active sites of sulfatases, contains a serine or cysteine residue that is capable of being converted (oxidized) to a 2-formylglycine (fGly) residue by action of a formylglycine generating enzyme (FGE) either in a cell-based system in an FGE-expressing host cell (e.g., at the time of translation of an ald tag-containing protein in a cell) or in a cell-free system (e.g., by contacting an ald tag-containing protein with an FGE in a cell-free system). The aldehyde moiety of the resulting fGly residue can be used as a "chemical handle" to facilitate site-specific chemical modification of the Ig polypeptide, and thus site-specific attachment of a payload (e.g., drug). For example, a peptide modified to contain an α-nucleophile-containing moiety (e.g., an aminooxy or hydrazide moiety) can be reacted with the fGly-containing Ig polypeptide to yield a conjugate in which the Ig polypeptide and the peptide are linked by a covalent bond, e.g., a hydrazone or oxime bond, or via alternative aldehyde-specific chemistries such as reductive amination, etc. The reactivity of the aldehyde thus allows for bioorthogonal and chemoselective modification of the Ig polypeptide, and thus provides a site-specific means for chemical modification that in turn can be exploited to provide for site-specific attachment of a payload in the final conjugate.

The tags may be positioned in an Ig heavy chain polypeptide in any suitable manner, as described herein. The tag in an antibody of the present disclosure is not positioned at the C-terminus of the Ig polypeptide, e.g., the C-terminus of the Ig heavy chain polypeptide. Thus, for example, if the tag has the sulfatase motif LCTPSR (SEQ ID NO:561), the last six amino acids of the Ig heavy chain polypeptide in which the tag is positioned is not LCTPSR (SEQ ID NO:561).

The tags may be positioned in an Ig heavy chain polypeptide in any suitable manner such that the tagged Ig heavy chain polypeptide, an antibody having the tagged heavy chain polypeptide, or both exhibit one or more desirable properties. The properties may be associated with, e.g., the tagged and/or the fGly-modified antibody produced in vitro (i.e., in a cellular expression system); and/or the antibody conjugate having a payload (e.g., drug) covalently bound to the antibody through fGly. The desirable properties may include, without limitation, higher titer of antibody production, higher conversion rate, higher conjugation yield (or conjugation efficiency) (e.g., as measured by the average molar ratio of payload to antibody, e.g., drug to antibody), lower aggregation rate (or higher percentage of antibody monomers), lower immunogenicity; and/or higher stability in serum, relative to reference measures for the respective properties. A tagged, fGly-modified or conjugated antibody of the present disclosure may be characterized in satisfying one or more threshold criteria, e.g., two or more threshold criteria, such as expression titer and/or conjugation yield (e.g., payload-to-antibody ratio (PAR), e.g., the drug-to-antibody ratio, or DAR, where the payload is a drug) that are higher than a threshold titer and/or a threshold yield, respectively.

A tagged or fGly-modified antibody of the present disclosure may exhibit a desirable titer of expression. "Titer of expression", "expression titer" and "titer" are used herein interchangeably, in reference to an antibody, to refer to the amount of antibody secreted in a cell culture supernatant by cultured cells that are genetically modified with suitable expression constructs encoding the antibody. The cells may be genetically modified to coexpress any convenient Ig light chain polypeptide with the tagged Ig heavy chain polypeptide. The cells may be further genetically modified with additional expression constructs encoding enzymes, or any other suitable polypeptide. In some cases, the cells may be genetically modified to express a formylglycine generating enzyme (FGE), as described herein. The threshold titer of expression may be, in some cases, about 20 mg/L or more, e.g., 30 mg/L or more, 40 mg/L or more, 50 mg/L or more, about 75 mg/L or more, about 100 mg/L or more, about 150 mg/L or more, about 200 mg/L or more, about 300 mg/L or more, about 400 mg/L or more, about 500 mg/L or more, about 600 mg/L or more, about 700 mg/L or more, about 800 mg/L or more, including about 1,000 mg/L or more. In some embodiments, the threshold titer of expression is in the range of about 20 mg/L to about 2,000 mg/L, e.g., about 30 mg/L to about 2,000 mg/L, about 50 mg/L to about 2,000 mg/L, about 100 mg/L to about 1,800 mg/L, about 200 mg/L to about 1,600 mg/L, about 300 mg/L to about 1,500 mg/L, or about 400 mg/L to about 1,500 mg/L. The antibody titer may be measured using, e.g., a biosensor chip system, such as a protein A-based biosensor assay run on the BLItz® system (Forte Bio, CA).

An fGly-modified antibody that includes a converted tag present in an Ig heavy chain polypeptide constant region, as disclosed herein, may exhibit a desirable conjugation efficiency, as expressed by the average molar ratio of payload to antibody (PAR) (e.g., drug-antibody ratio (DAR), where the payload is a drug), when the fGly-modified antibody is conjugated with a payload, such as a drug, through the fGly in a suitable reaction mixture. The payload prior to conjugation with the fGly-modified antibody may be covalently attached to a suitable reactive group, e.g., an aldehyde-reactive group, that reacts with the aldehyde of the fGly residue of the fGly-modified antibody in the reaction mixture under suitable conditions. In some embodiments, the conjugation efficiency is about 0.5 or more, e.g., about 0.75 or more, about 1.0 or more, about 1.1 or more, about 1.2 or more, about 1.3 or more, about 1.6 or more, about 1.7 or more, about 1.8 or more, and up to 2.0. In some embodiments, the conjugation efficiency is in the range of about 0.5 to about 2.0, e.g., about 0.75 to about 2.0, about 1.0 to about 1.9, about 1.3 to about 1.9, or about 1.6 to 1.8. The conjugation yield may be measured by performing, e.g., hydrophobic interaction chromatography (HIC), after a conjugation reaction.

An antibody conjugate of the present disclosure (e.g., an antibody having a payload, such as a drug, covalently bound thereto through an fGly of an aldehyde-tagged Ig heavy chain constant region of the antibody) may show an acceptable level of aggregation, as represented by the proportion of antibody monomers. "Antibody monomer," as used herein, may refer to an antigen-binding unit containing, e.g., a pair of Ig light chain and a pair of Ig heavy chain polypeptides. Aggregation occurs when more than one antibody monomers associate together (and therefore are no longer antibody monomers). Thus, two or more antibody monomers can associate with each other to form an aggregate. The proportion of antibody monomers may be affected by the aggregation of antibody monomers as well as disassociation of one of more Ig polypeptides of an antibody monomer.

In certain embodiments, the proportion of antibody monomers is about 20% or more, e.g., about 30% or more, about 40% or more, about 50% or more, about 60% or more, about 70% or more, about 80% or more, about 90% or more, including about 95% or more. In some cases, the percentage of antibody monomers is in the range of from about 20% to about 99%, e.g., from about 30% to about 99%, from about 40% to about 99%, from about 50% to about 99%, from about 60% to about 98%, from about 70% to about 98%, from about 80% to about 98%, including from about 90% to about 98%. The proportion of antibody monomers may be measured using, e.g., size exclusion chromatography.

An antibody conjugate of the present disclosure may bind an antigen with a suitable binding activity (e.g., specificity, binding affinity, etc.) compared to the parent antibody (i.e., the antibody without a payload conjugated thereto, or the antibody having an Ig heavy chain polypeptide without the tag sequence inserted in the constant region). In some cases, the antibody conjugate has binding activity toward an antigen that is substantially the same as the binding activity of a parent antibody that does not have a tag sequence inserted in the constant region of the Ig heavy chain polypeptide. The binding activity may be measured by, e.g., an enzyme-linked immunosorbent assay (ELISA).

The present antibody conjugates may find use in delivering a conjugated payload (e.g., drug) to a target site, where the antibody conjugate may bind specifically to an antigen specific for, or enriched at, the target site. For example, the antibody conjugate may specifically recognize a tumor antigen and enhance site-specific delivery of a chemotherapeutic drug conjugated to the antibody to the tumor.

Further aspects of the present disclosure are now described.

Tags Containing a Sulfatase Motif

An antibody of the present disclosure includes a tag, i.e., includes an amino acid sequence containing a sulfatase motif which is capable of being converted, by action of FGE, to provide a fGly in the sulfatase motif, in an Ig heavy chain polypeptide constant region. The tag may include a sulfatase motif having a length of 5 amino acid residues or more, e.g., 6 amino acid residues or more, 7 amino acid residues or more, 8 amino acid residues or more, including 10 amino acid residues or more, and in some cases may have a length of 15 amino acid residues or less, e.g., 12 amino acid residues or less, 11 amino acid residues or less, 10 amino acid residues or less, including 8 amino acid residues or less. In some embodiments, the tag includes a sulfatase motif having a length in the range of 5 to 15 amino acid residues, e.g., 5 to 12 amino acid residues, 5 to 10 amino acid residues, including 6 to 8 residues. In some embodiments, the sulfatase motif includes 5 or 6 amino acid residues.

In some embodiments, the tag includes at least a minimal sulfatase motif (also referred to a "consensus sulfatase motif"), having 5 or 6 amino acid residues, and additional sequence flanking the minimal sulfatase motif. The additional sequence may be N- and/or C-terminal to the minimal sulfatase motif.

In certain embodiments, the sulfatase motif may be described by the formula:

$$X^1Z^1X^2Z^2X^3Z^3 \qquad (I)$$

where $Z^1$ cysteine or serine (which can also be represented by (C/S)); $Z^2$ is either a proline or alanine residue (which can also be represented by (P/A)); $Z^3$ is a basic amino acid (e.g., arginine (R), and may be lysine (K) or histidine (H), usually lysine), or an aliphatic amino acid (alanine (A), glycine (G), leucine (L), valine (V), isoleucine (I), or proline (P), usually A, G, L, V, or I; $X^1$ is present or absent and, when present, can be any amino acid, though usually an aliphatic amino acid, a sulfur-containing amino acid, or a polar, uncharged amino acid, (i.e., other than a aromatic amino acid or a charged amino acid), usually L, M, V, S or T, more usually L, M, S or V; and $X^2$ and $X^3$ independently can be any amino acid, though usually an aliphatic amino acid, a polar, uncharged amino acid, or a sulfur containing amino acid (i.e., other than an aromatic amino acid or a charged amino acid), usually S, T, A, V, G or C, more usually S, T, A, V or G.

Thus, the present disclosure provides an antibody, where the Ig heavy chain polypeptide of the antibody includes a constant region amino acid sequence modified to provide a tag having at least 5 amino acids and having the formula $X^1Z^1X^2Z^2X^3Z^3$, where $Z^1$ is cysteine or serine; $Z^2$ is a proline or alanine residue; $Z^3$ is an aliphatic amino acid or a basic amino acid; $X^1$ is present or absent and, when present, is any amino acid; $X^2$ and $X^3$ are each independently any amino acid, and where the Ig heavy chain polypeptide includes a heavy chain constant region containing one or more, e.g., two or more, or 3 or more, of the amino acid sequences set forth in SEQ ID NOs:179-369, shown in Tables 1-4, as described further below.

It should be noted that, following action of an FGE on the sulfatase motif, $Z^1$ is oxidized to generate a formylglycine (fGly) residue. Furthermore, following both FGE-mediated conversion and reaction with a reactive partner comprising a moiety of interest (i.e., a payload, e.g., drug, detectable label, water soluble polymer, polypeptide, etc.), fGly position at $Z^1$ in the formula above is covalently bound to the payload.

The sulfatase motif of the tag is generally selected so as to be capable of conversion by a selected FGE, e.g., an FGE present in a host cell in which the antibody of the present disclosure is expressed or an FGE which is to be contacted with the antibody of the present disclosure in a cell-free, in vitro method.

Selection of tags and an FGE that provide for conversion of a tag to include an fGly in the target antibody containing a tagged Ig heavy chain polypeptide can be readily accomplished in light of information available in the art. In general, sulfatase motifs susceptible to conversion by a eukaryotic FGE contain a cysteine and a proline (i.e., a cysteine and proline at $Z^1$ and $Z^2$, respectively, in Formula I above (e.g., $X^1CX^2PX^3Z^3$) and are modified by the "SUMF1-type" FGE (Cosma et al. Cell 2003, 113, (4), 445-56; Dierks et al. Cell 2003, 113, (4), 435-44). Sulfatase motifs susceptible to conversion by a prokaryotic FGE contain either a cysteine or a serine, and a proline in the sulfatase motif (i.e., a cysteine or serine at $Z^1$, and a proline at $Z^2$, respectively, in Formula I above (e.g., $X^1(C/S)X^2PX^3Z^3$) are modified either by the "SUMF1-type" FGE or the "AtsB-type" FGE, respectively (Szameit et al. J Biol Chem 1999, 274, (22), 15375-81). Other sulfatase motifs susceptible to conversion by a prokaryotic FGE contain either a cysteine or a serine, and either a proline or an alanine in the sulfatase motif (i.e., a cysteine or serine at $Z^1$, and a proline or alanine at $Z_2$, respectively, in Formula I or II above (e.g., $X^1CX^2PX^3R$; $X^1SX^2PX^2R$; $X^1CX^2AX^3R$; $X^1SX^2AX^3R$; $CX^1PX^2R$; $SX^1PX^2R$; $CX^1AX^2R$; $SX^1AX^2R$, $X^1CX^2PX^3Z^3$; $X^1SX^2PX^2Z^3$; $X^1CX^2AX^3Z^3$; $X^1SX^2AX^3Z^3$; $CX^1PX^2Z^3SX^1PX^2Z^3$; $CX^1AX^2Z^3$; $SX^1AX^2Z^3$), and are susceptible to modification by, for example, can be modified by an FGE of a Firmicutes (e.g., *Clostridium perfringens*) (see Berteau et al. J. Biol. Chem. 2006; 281:22464-22470) or an FGE of *Mycobacterium tuberculosis*.

Therefore, for example, where the FGE is a eukaryotic FGE (e.g., a mammalian FGE, including a human FGE), the sulfatase motif is usually of the formula: $X^1CX^2PX^3Z^3$, where $X^1$ may be present or absent and, when present, can be any amino acid, though usually an aliphatic amino acid, a sulfur-containing amino acid, or a polar, uncharged amino acid, (i.e., other than a aromatic amino acid or a charged amino acid), usually L, M, S or V; $X^2$ and $X^3$ independently can be any amino acid, though usually an aliphatic amino acid, a sulfur-containing amino acid, or a polar, uncharged amino acid, (i.e., other than a aromatic amino acid or a charged amino acid), usually S, T, A, V, G, or C, more usually S, T, A, V or G; and $Z^3$ is a basic amino acid (e.g., arginine (R), and may be lysine (K) or histidine (H), usually lysine), or an aliphatic amino acid (alanine (A), glycine (G), leucine (L), valine (V), isoleucine (I), or proline (P), usually A, G, L, V, or I.

Specific examples of sulfatase motifs include LCTPSR (SEQ ID NO:561), MCTPSR (SEQ ID NO:563), VCTPSR (SEQ ID NO:564), LCSPSR (SEQ ID NO:565), LCAPSR (SEQ ID NO:566), LCVPSR (SEQ ID NO:567), LCGPSR (SEQ ID NO:568), ICTPAR (SEQ ID NO:569), LCTPSK (SEQ ID NO:570), MCTPSK (SEQ ID NO:571), VCTPSK (SEQ ID NO:572), LCSPSK (SEQ ID NO:573), LCAPSK (SEQ ID NO:574), LCVPSK (SEQ ID NO:575), LCGPSK (SEQ ID NO:576), LCTPSA (SEQ ID NO:577), ICTPAA (SEQ ID NO:578), MCTPSA (SEQ ID NO:579), VCTPSA (SEQ ID NO:580), LCSPSA (SEQ ID NO:581), LCAPSA (SEQ ID NO:582), LCVPSA (SEQ ID NO:583), LCGPSA (SEQ ID NO:584), LSTPSR (SEQ ID NO:562), MSTPSR (SEQ ID NO:585), VSTPSR (SEQ ID NO:586), LSSPSR (SEQ ID NO:587), LSAPSR (SEQ ID NO:588), LSVPSR (SEQ ID NO:589), LSGPSR (SEQ ID NO:590), ISTPAR (SEQ ID NO:591), LSTPSK (SEQ ID NO:592), MSTPSK (SEQ ID NO:593), VSTPSK (SEQ ID NO:594), LSSPSK (SEQ ID NO:595), LSAPSK (SEQ ID NO:596), LSVPSK (SEQ ID NO:597), LSGPSK (SEQ ID NO:598), LSTPSA (SEQ ID NO:599), ISTPAA (SEQ ID NO:600), MSTPSA (SEQ ID NO:601), VSTPSA (SEQ ID NO:602), LSSPSA (SEQ ID NO:603), LSAPSA (SEQ ID NO:604), LSVPSA (SEQ ID NO:605), and LSGPSA (SEQ ID NO:606). Other specific sulfatase motifs are readily apparent from the disclosure provided herein.

Antibodies Containing a Tagged Immunologlobulin Heavy Chain Polypeptide

An antibody of the present disclosure contains a tag, as described above, in the amino acid sequence of an Ig heavy chain polypeptide constant region, where the tag is positioned between two consecutive amino acids in the constant region of a corresponding parent Ig heavy chain polypeptide, e.g., the Ig heavy chain polypeptide without the tag in the constant region. In other words, the amino acid sequence of the present tag may be present in an Ig heavy chain polypeptide such that the tag amino acid sequence is directly flanked N-terminally by a first flanking sequence identical to a first contiguous sequence in a corresponding parent Ig heavy chain constant region, and C-terminally directly flanked by a second flanking sequence identical to a second contiguous sequence in the corresponding parent Ig heavy chain constant region, where the first contiguous sequence is more N-terminal to the second contiguous sequence in the parent Ig heavy chain constant region amino acid sequence, and the first and second contiguous sequences are contiguous in the parent Ig heavy chain constant region amino acid sequence. In some cases, the tag amino acid sequence is positioned at the N-terminal end of the Ig heavy chain constant region, in which case, the tag is C-terminally directly flanked by the Ig heavy chain constant region and N-terminally directly flanked by a $V_H$ region.

In the antibody of the present disclosure, the tag is positioned in the Ig heavy chain polypeptide at an N-terminal end or an internal site of the constant region. Thus, the tag is not positioned at the C-terminal end of the Ig heavy chain polypeptide.

The parent heavy chain polypeptide may be an IgG1, IgG2, IgG3, or IgG4 heavy chain polypeptide, having an Ig constant region amino acid sequence, e.g., as shown in FIG. 13. Thus, in some cases, the Ig heavy chain polypeptide is a human Ig heavy chain polypeptide, e.g., human IgG1, human IgG2, human IgG3, or human IgG4 heavy chain polypeptide. In some cases, the Ig heavy chain constant region is a human Ig heavy chain constant region, e.g., human IgG1, human IgG2, human IgG3, or human IgG4 heavy chain constant region. In some cases, the parent IgG1 heavy chain polypeptide, on which the present antibody may be based, includes a constant region amino acid sequence 75% or more, e.g., 80% or more, 85% or more, 90% or more, 95% or more, 97% or more, and up to 100% identical to the amino acid sequence set forth in SEQ ID NO:1. In some cases, the parent IgG2 heavy chain polypeptide, on which the present antibody may be based, includes a constant region amino acid sequence 75% or more, e.g., 80% or more, 85% or more, 90% or more, 95% or more, 97% or more, and up to 100% identical to the amino acid sequence set forth in SEQ ID NO:2. In some cases, the parent IgG3 heavy chain polypeptide, on which the present antibody may be based, includes a constant region amino acid sequence 75% or more, e.g., 80% or more, 85% or more, 90% or more, 95% or more, 97% or more, and up to 100% identical to the amino acid sequence set forth in SEQ ID NO:3. In some cases, the parent IgG4 heavy chain polypeptide, on which the present antibody may be based, includes a constant region amino acid sequence 75% or more, e.g., 80% or more, 85% or more, 90% or more, 95% or more, 97% or more, and up to 100% identical to the amino acid sequence set forth in SEQ ID NO:4.

Thus, in some embodiments, an antibody of the present disclosure, containing a tag, may include an Ig heavy chain derived from a parent Ig heavy chain polypeptide that is based on an IgG1 heavy chain polypeptide, where the antibody contains an IgG1 heavy chain polypeptide that includes a constant region amino acid sequence, excluding any tags, that is 75% or more, e.g., 80% or more, 85% or more, 90% or more, 95% or more, 97% or more, and up to 100% identical to the amino acid sequence set forth in SEQ ID NO:1.

In some embodiments, an antibody of the present disclosure, containing a tag, may include an Ig heavy chain derived from a parent Ig heavy chain polypeptide that is based on an IgG2 heavy chain polypeptide, where the antibody contains an IgG2 heavy chain polypeptide that includes a constant region amino acid sequence, excluding any tags, that is 75% or more, e.g., 80% or more, 85% or more, 90% or more, 95% or more, 97% or more, and up to 100% identical to the amino acid sequence set forth in SEQ ID NO:2.

In some embodiments, an antibody of the present disclosure, containing a tag, may include an Ig heavy chain derived from a parent Ig heavy chain polypeptide that is based on an IgG3 heavy chain polypeptide, where the antibody contains an IgG3 heavy chain polypeptide that includes a constant region amino acid sequence, excluding any tags, that is 75% or more, e.g., 80% or more, 85% or more, 90% or more, 95% or more, 97% or more, and up to 100% identical to the amino acid sequence set forth in SEQ ID NO:3.

In some embodiments, an antibody of the present disclosure, containing a tag, may include an Ig heavy chain derived from a parent Ig heavy chain polypeptide that is based on an IgG4 heavy chain polypeptide, where the antibody contains an IgG4 heavy chain polypeptide that includes a constant region amino acid sequence, excluding any tags, that is 75% or more, e.g., 80% or more, 85% or more, 90% or more, 95% or more, 97% or more, and up to 100% identical to the amino acid sequence set forth in SEQ ID NO:4.

The present disclosure contemplates an antibody that includes an Ig heavy chain based on any suitable allotype, e.g., human allotype. In some embodiments, an antibody of the present disclosure is based on an allotype of human IgG1. The IgG1 heavy chain allotypes of interest include, without limitation, G1m17, 1 (having R at position 97, D at position 239, and L at position 241 of SEQ ID NO:1); G1m17,1,2 (having R at position 97, D at position 239, L at position, and G at position 314 of SEQ ID NO:1); and G1m3 (having R at position 97 of SEQ ID NO:1). Thus in some cases, the antibody contains an Ig heavy chain polypeptide that includes a constant region amino acid sequence, exclusive of any tags, that is 75% or more, e.g., 80% or more, 85% or more, 90% or more, 95% or more, 97% or more, and up to 100% identical to the G1m17, lallotype of IgG1 heavy chain having the amino acid sequence set forth in SEQ ID NO:1, where position 97 is R, position 239 is D, and position 241 is L. In some cases, the antibody contains an Ig heavy chain polypeptide that includes a constant region amino acid sequence, exclusive of any tags, that is 75% or more, e.g., 80% or more, 85% or more, 90% or more, 95% or more, 97% or more, and up to 100% identical to the G1m17,1,2 allotype of IgG1 heavy chain having the amino acid sequence set forth in SEQ ID NO:1, where position 97 is R, position 239 is D, position 241 is L, and position 314 is G. In some cases, the antibody contains an Ig heavy chain polypeptide that includes a constant region amino acid sequence, exclusive of any tags, that is 75% or more, e.g., 80% or more, 85% or more, 90% or more, 95% or more, 97% or more, and up to 100% identical to the G1m3 allotype of IgG1 heavy chain having the amino acid sequence set forth in SEQ ID NO:1, where position 97 is R.

In some cases, the tag is positioned within or adjacent a solvent-accessible region of the Ig heavy chain polypeptide constant region, and in some cases, the tag is not positioned within or adjacent a solvent-accessible region of the Ig heavy chain polypeptide constant region. Solvent accessible loops of an antibody can be identified by molecular modeling, or by comparison to a known antibody structure. The relative accessibility of amino acid residues can also be calculated using a method of DSSP (Dictionary of Secondary Structure in Proteins; Kabsch and Sander 1983 Biopolymers 22: 2577-637) and solvent accessible surface area of an amino acid may be calculated based on a 3-dimensional model of an antibody, using algorithms known in the art (e.g., Connolly, J. Appl. Cryst. 16, 548 (1983) and Lee and Richards, J. Mol. Biol. 55, 379 (1971), both of which are incorporated herein by reference). Suitable solvent accessible loop in the constant region of Ig heavy chain polypeptides are described in, e.g., PCT publication number WO 2012/097333, which is incorporated herein by reference.

The tag may be positioned in the Ig heavy chain constant region, in the $C_H1$, $C_H2$, $C_H3$, or the hinge domain. The $C_H1$ domain corresponds to: positions 1-98 of the amino acid sequence of IgG1, as set forth in SEQ ID NO:1; positions 1-98 of the amino acid sequence of IgG2, as set forth in SEQ ID NO:2; positions 1-98 of the amino acid sequence of IgG3, as set forth in SEQ ID NO:3; and positions 1-98 of the amino acid sequence of IgG4, as set forth in SEQ ID NO:4. The $C_H2$ domain corresponds to: positions 114-223 of the amino acid sequence of IgG1, as set forth in SEQ ID NO:1; positions 111-219 of the amino acid sequence of IgG2, as set forth in SEQ ID NO:2; positions 161-270 of the amino acid sequence of IgG3, as set forth in SEQ ID NO:3; and positions 111-220 of the amino acid sequence of IgG4, as set forth in SEQ ID NO:4. The $C_H3$ domain corresponds to: positions 224-330 of the amino acid sequence of IgG1, as set forth in SEQ ID NO:1; positions 220-326 of the amino acid sequence of IgG2, as set forth in SEQ ID NO:2; positions 271-377 of the amino acid sequence of IgG3, as set forth in SEQ ID NO:3; and positions 221-327 of the amino acid sequence of IgG4, as set forth in SEQ ID NO:4. The hinge domain corresponds to: positions 99-113 of the amino acid sequence of IgG1, as set forth in SEQ ID NO:1; positions 99-110 of the amino acid sequence of IgG2, as set forth in SEQ ID NO:2; positions 99-160 of the amino acid sequence of IgG3, as set forth in SEQ ID NO:3; and positions 99-110 of the amino acid sequence of IgG4, as set forth in SEQ ID NO:4.

Antibodies Having a Tag in a CH1 Domain of an Ig Heavy Chain Constant Region

In some embodiments, an antibody of the present disclosure includes a tag in the $C_H1$ domain of an Ig heavy chain polypeptide constant region. Thus, the antibody may include a tag having an amino acid sequence of the formula $X^1Z^1X^2Z^2X^3Z^3$, where $X^1$, $X^2$, $X^3$, $Z^1$, $Z^2$ and $Z^3$ are as described above (in ", and where the Ig heavy chain polypeptide includes a constant region containing, in the $C_H1$ domain, any one or more (e.g., two or more, or three or more) of the amino acid sequences set forth in SEQ ID NOs:179-251, shown in Table 1. In some embodiments, the antibody provides for an antibody titer of about 200 mg/L or greater. In some cases, the antibody, when the tag is converted, as described herein, provides for a conjugation efficiency, represented by the average molar ratio of payload to antibody (PAR, e.g., drug-to-antibody ratio (DAR)), of about 0.5 or greater. In some cases, an antibody conjugate that includes a payload conjugated to the present antibody via an fGly of a converted tag in the $C_H1$ domain of the Ig heavy chain polypeptide constant region, as described below, exhibits in solution a proportion of antibody monomers of about 40% or greater. In some embodiments, $Z^3$ is arginine. In some embodiments, $X^1$ is glycine, leucine, isoleucine, methionine, histidine, tyrosine, valine, serine, cysteine or threonine. In some embodiments, $X^2$ and $X^3$ are each independently serine, threonine, alanine, valine, glycine or cysteine. In some embodiments, the tag includes the amino acid sequence LCTPSR (SEQ ID NO:561).

TABLE 1

| Position | Sequence | SEQ ID NO: |
|---|---|---|
| 1A | $X^1Z^1X^2Z^2X^3Z^3$AS | 179 |
| 2S | $AX^1Z^1X^2Z^2X^3Z^3$STK | 180 |
| 4K | $TX^1Z^1X^2Z^2X^3Z^3$KGP | 181 |
| 5G | $KX^1Z^1X^2Z^2X^3Z^3$GPSVFP | 182 |
| 7S | $PX^1Z^1X^2Z^2X^3Z^3$SVFP | 183 |
| 8V | $PSX^1Z^1X^2Z^2X^3Z^3$VFP | 184 |
| 9F | $VX^1Z^1X^2Z^2X^3Z^3$FPL | 185 |
| 14S | $APX^1Z^1X^2Z^2X^3Z^3$[SSK/CSR] | 186 |
| 16K | $SSX^1Z^1X^2Z^2X^3Z^3$KST | 187 |
| 16R | $CSX^1Z^1X^2Z^2X^3Z^3$RS | 188 |
| 17S | [SK/-R]$X^1Z^1X^2Z^2X^3Z^3$STS | 189 |
| 18T | $KSX^1Z^1X^2Z^2X^3Z^3$TSGG | 190 |
| 18T | $RSX^1Z^1X^2Z^2X^3Z^3$TS[GG/E-] | 191 |
| 19S | $KSTX^1Z^1X^2Z^2X^3Z^3$SGG | 192 |
| 19S | $RSTX^1Z^1X^2Z^2X^3Z^3$S[GG/E-] | 193 |
| 20G | $TSX^1Z^1X^2Z^2X^3Z^3$[GG/ES]T | 194 |
| 21G | $SGX^1Z^1X^2Z^2X^3Z^3$GTA | 195 |
| 21S | $EX^1Z^1X^2Z^2X^3Z^3$STA | 196 |
| 22T | [GG/ES]$X^1Z^1X^2Z^2X^3Z^3$TA | 197 |
| 23A | [-G/ES]$TX^1Z^1X^2Z^2X^3Z^3$AA | 198 |
| 24A | $TAX^1Z^1X^2Z^2X^3Z^3$ALG | 199 |
| 25L | $AAX^1Z^1X^2Z^2X^3Z^3$LGC | 200 |
| 26G | $ALX^1Z^1X^2Z^2X^3Z^3$GC | 201 |
| 36P | $PEX^1Z^1X^2Z^2X^3Z^3$PVT | 202 |
| 41W | $VSX^1Z^1X^2Z^2X^3Z^3$WN | 203 |
| 42N | $SWX^1Z^1X^2Z^2X^3Z^3$NSG | 204 |
| 43S | $WNX^1Z^1X^2Z^2X^3Z^3$SGA | 205 |
| 44G | $NSX^1Z^1X^2Z^2X^3Z^3$GA | 206 |
| 45A | $NSGX^1Z^1X^2Z^2X^3Z^3$ALT | 207 |
| 46L | $GAX^1Z^1X^2Z^2X^3Z^3$LTS | 208 |
| 47T | $GALX^1Z^1X^2Z^2X^3Z^3$TS | 209 |
| 48S | $LTX^1Z^1X^2Z^2X^3Z^3$SGV | 210 |
| 49G | $LTSX^1Z^1X^2Z^2X^3Z^3$GVH | 211 |
| 50V | $LTSGX^1Z^1X^2Z^2X^3Z^3$VHT | 212 |
| 51H | $GVX^1Z^1X^2Z^2X^3Z^3$HTF | 213 |
| 52T | $VHX^1Z^1X^2Z^2X^3Z^3$TFP | 214 |
| 53F | $HTX^1Z^1X^2Z^2X^3Z^3$FPA | 215 |
| 60S | $QSX^1Z^1X^2Z^2X^3Z^3$SG | 216 |
| 61G | $QSSX^1Z^1X^2Z^2X^3Z^3$GLY | 217 |
| 62L | $SSGX^1Z^1X^2Z^2X^3Z^3$LYSL | 218 |
| 63Y | $GLX^1Z^1X^2Z^2X^3Z^3$YSL | 219 |
| 64S | $LYX^1Z^1X^2Z^2X^3Z^3$SLSS | 220 |
| 66S | $SLX^1Z^1X^2Z^2X^3Z^3$SSV | 221 |
| 69V | $SSVX^1Z^1X^2Z^2X^3Z^3$VTV | 222 |
| 70T | $VVX^1Z^1X^2Z^2X^3Z^3$TVP | 223 |
| 71V | $VVTX^1Z^1X^2Z^2X^3Z^3$VP | 224 |
| 72P | $VVTVX^1Z^1X^2Z^2X^3Z^3$PSS[S/N] | 225 |
| 73S | $VPX^1Z^1X^2Z^2X^3Z^3$SSS | 226 |
| 74S | $VPSX^1Z^1X^2Z^2X^3Z^3$S[SL/NF] | 227 |
| 75S | $VPSSX^1Z^1X^2Z^2X^3Z^3$[SLGT/NF--] | 228 |
| 76L | $SSSX^1Z^1X^2Z^2X^3Z^3$LGT | 229 |
| 76F | $SSNX^1Z^1X^2Z^2X^3Z^3$FG | 230 |
| 77G | [SSL/-NF]$X^1Z^1X^2Z^2X^3Z^3$GT | 231 |
| 78T | $SLGX^1Z^1X^2Z^2X^3Z^3$T[Q/K]T | 232 |
| 78T | $FGX^1Z^1X^2Z^2X^3Z^3$TQT | 233 |
| 79Q | $LGTX^1Z^1X^2Z^2X^3Z^3$[QT-/KTY] | 234 |
| 79Q | $FGTX^1Z^1X^2Z^2X^3Z^3$QT | 235 |
| 80T | $TQX^1Z^1X^2Z^2X^3Z^3$TY[I/T] | 236 |
| 80T | $GTKX^1Z^1X^2Z^2X^3Z^3$TYT | 237 |

TABLE 1-continued

| Position | Sequence | SEQ ID NO: |
|---|---|---|
| 81Y | QTX$^1$Z$^1$X$^2$Z$^2$X$^3$Z$^3$Y[I-/TC] | 238 |
| 81Y | TKTX$^1$Z$^1$X$^2$Z$^2$X$^3$Z$^3$YTC | 239 |
| 82I | TYX$^1$Z$^1$X$^2$Z$^2$X$^3$Z$^3$[IC-/TCN] | 240 |
| 83C | Y[I/T]X$^1$Z$^1$X$^2$Z$^2$X$^3$Z$^3$CN | 241 |
| 86N | NVX$^1$Z$^1$X$^2$Z$^2$X$^3$Z$^3$[NHK/DH-] | 242 |
| 88K | [N/D]HX$^1$Z$^1$X$^2$Z$^2$X$^3$Z$^3$KPS | 243 |
| 89P | HKX$^1$Z$^1$X$^2$Z$^2$X$^3$Z$^3$PSN | 244 |
| 90S | KPX$^1$Z$^1$X$^2$Z$^2$X$^3$Z$^3$SNT | 245 |
| 91N | KPSX$^1$Z$^1$X$^2$Z$^2$X$^3$Z$^3$NTK | 246 |
| 92T | PSNX$^1$Z$^1$X$^2$Z$^2$X$^3$Z$^3$TKV | 247 |
| 93K | NTX$^1$Z$^1$X$^2$Z$^2$X$^3$Z$^3$KVD | 248 |
| 94V | NTKX$^1$Z$^1$X$^2$Z$^2$X$^3$Z$^3$VDK[K/T/R] | 249 |
| 95D | KVX$^1$Z$^1$X$^2$Z$^2$X$^3$Z$^3$DK[K/T/R] | 250 |
| 97V | DKX$^1$Z$^1$X$^2$Z$^2$X$^3$Z$^3$[K/T/R]VE | 251 |

([*/*] denotes alternative amino acids (or amino acid sequences) chosen from the amino acid residues (or sequences) separated by "/". "-" denotes that no amino acid is required there to specify the position)

As described above, the tag may be positioned between two consecutive amino acids in the C$_H$1 domain of the constant region of a corresponding parent Ig heavy chain polypeptide, e.g., the Ig heavy chain polypeptide without the tag in the constant region. In some cases, the tag is positioned at the N-terminal end of the Ig heavy chain polypeptide constant region (i.e., between the V$_H$ region and the C$_H$ region of the Ig heavy chain). Thus, the position of the tag in the Ig heavy chain amino acid sequence may be defined by the position of the most N-terminal amino acid of the amino acid sequence flanking the tag at its C-terminal end. In some embodiments, the tag is positioned adjacent and N-terminal to an amino acid residue of the Ig heavy chain polypeptide constant region (e.g., IgG1, IgG2, IgG3 or IgG4 constant region) corresponding to one or more (e.g., two or more, including three or more) of residues 1, 2, 4, 5, 7-9, 14, 16-26, 36, 41-53, 60-64, 66, 69-83, 86, 88-95, and 97 of SEQ ID NO:1.

The parent Ig heavy chain polypeptide may be modified to insert the tag in the amino acid sequence of the constant region in the C$_H$1 domain such that an antibody that includes the tag in its Ig heavy chain polypeptide, when the tag is converted, achieves a conjugation efficiency expressed as the payload to antibody ratio (e.g., drug to antibody ratio) of about 0.5 or greater. In some embodiments, the antibody achieves an antibody titer of about 200 mg/L or greater; and/or when the tag is converted and conjugated to a payload via fGly of the converted tag, a proportion of antibody monomers in solution of about 40% or greater. Insertion sites of interest in an Ig heavy chain polypeptide (e.g., IgG1, IgG2, IgG3 or IgG4 constant region polypeptide) include the position immediately N-terminal to an amino acid residue corresponding to one or more (e.g., two or more, including three or more) of positions 1, 2, 4, 5, 7-9, 14, 16-26, 36, 41-53, 60-64, 66, 69-83, 86, 88-95, and 97, of SEQ ID NO:1.

In certain embodiments, an antibody of the present disclosure includes an Ig heavy chain polypeptide containing an amino acid sequence at least 90%, e.g., at least 95%, at least 97%, at least 99%, including 100% identical to any one of the sequences set forth in SEQ ID NOs:5-12 and 14-69, shown in Table 7 in FIG. 15, where the amino acid sequence includes the tag, i.e., the FGE substrate motif: LCTPSR (SEQ ID NO:561) in the constant region C$_H$1 domain. In certain embodiments, the present antibody having the tagged Ig heavy chain polypeptide may exhibit an antibody titer of about 200 mg/L or greater, e.g., about 300 mg/L or greater, about 400 mg/L or greater, about 500 mg/L or greater, or about 600 mg/L or greater. In some embodiments, the present antibody having the tagged Ig heavy chain polypeptide may exhibit, when the tag is converted, a conjugation efficiency (e.g., DAR) of about 0.5 or greater, e.g., about 1.0 or greater, about 1.6 or greater, or about 1.7 or greater. In some embodiments, the present antibody having the tagged Ig heavy chain polypeptide may exhibit, when the tag is converted and conjugated to a payload via fGly of the converted tag, a proportion of antibody monomers in solution of about 40% or greater, e.g., about 50% or greater, about 60% or greater, about 70% or greater, about 80% or greater, about 90% or greater, including about 95% or greater.

In certain embodiments, an antibody of the present disclosure, when the tag is converted, provides for a conjugation efficiency (e.g., DAR) of about 1.0 or greater. In some embodiments, the antibody provides for an antibody titer of about 200 mg/L or greater. An antibody conjugate that includes a payload conjugated to the present antibody via an fGly of a converted tag in the C$_H$1 domain of the Ig heavy chain polypeptide constant region may exhibit in solution a proportion of antibody monomers of about 70% or greater. In some embodiments, the antibody includes a tagged Ig heavy chain polypeptide, where the tag contains an amino acid sequence of the formula X$^1$Z$^1$X$^2$Z$^2$X$^3$Z$^3$, where X$^1$, X$^2$, X$^3$, Z$^1$, Z$^2$ and Z$^3$ are as described above (in ", and where the Ig heavy chain polypeptide includes a constant region containing any one or more (e.g., two or more, including three or more) of the amino acid sequences set forth in SEQ ID NOs:181, 182-184, 186, 190-201, 205-214, 216-220, 222-241, 244-250 of Table 1. In some embodiments, Z$^3$ is arginine. In some embodiments, X$^1$ is glycine, leucine, isoleucine, methionine, histidine, tyrosine, valine, serine, cysteine or threonine. In some embodiments, X$^2$ and X$^3$ are each independently serine, threonine, alanine, valine, glycine or cysteine. In some embodiments, the tag includes the amino acid sequence LCTPSR (SEQ ID NO:561).

The tag may be positioned between two consecutive amino acids in the C$_H$1 domain of the constant region of a corresponding parent Ig heavy chain polypeptide, e.g., the Ig heavy chain polypeptide without the tag in the constant region. Thus, the position of the tag in the Ig heavy chain amino acid sequence may be defined by the position of the most N-terminal amino acid of the amino acid sequence flanking the tag at its C-terminal end. In some embodiments, the tag is positioned adjacent and N-terminal to an amino acid residue of the Ig heavy chain polypeptide constant region (e.g., IgG1, IgG2, IgG3 or IgG4 constant region) corresponding to one or more (e.g., two or more, including three or more) of residues 4, 5, 7, 8, 14, 18-26, 43-52, 60-64, 69-83, and 89-95, of SEQ ID NO:1.

The parent Ig heavy chain polypeptide may be modified to insert the tag in the amino acid sequence of the constant region in the C$_H$1 domain such that an antibody that includes the tag in its Ig heavy chain polypeptide, when the tag is converted, achieves a conjugation efficiency expressed as the payload to antibody ratio (e.g., drug to antibody ratio) of about 1.0 or greater. In some embodiments, the antibody achieves an antibody titer of about 200 mg/L or greater; and/or when the tag is converted and conjugated to a payload via fGly of the converted tag, a proportion of antibody monomers in solution of about 70% or greater. Insertion sites of interest in an Ig heavy chain polypeptide (e.g., IgG1, IgG2, IgG3 or IgG4 constant region polypeptide) include the position immediately N-terminal to an amino acid residue corresponding to one or more (e.g., two or more, including three or more) of positions 4, 5, 7, 8, 14, 18-26, 43-52, 60-64, 69-83, and 89-95, of SEQ ID NO:1.

In certain embodiments, an antibody of the present disclosure includes an Ig heavy chain polypeptide containing an amino acid sequence at least 90%, e.g., at least 95%, at least 97%, at least 99%, including 100% identical to any one of the sequences set forth in SEQ ID NOs:7-10, 12, 16-24, 28-37, 39-43, 45-59, and 62-68, shown in Table 7 in FIG. 15, where the amino acid sequence includes the tag, i.e., the FGE substrate motif: LCTPSR (SEQ ID NO:561) in the constant region $C_H1$ domain. In certain embodiments, the present antibody having the tagged Ig heavy chain polypeptide may exhibit an antibody titer of about 200 mg/L or greater, e.g., about 300 mg/L or greater, about 400 mg/L or greater, about 500 mg/L or greater, or about 600 mg/L or greater. In some embodiments, the present antibody having the tagged Ig heavy chain polypeptide may exhibit, when the tag is converted, a conjugation efficiency (e.g., DAR) of about 1.0 or greater, about 1.6 or greater, or about 1.7 or greater. In some embodiments, the present antibody having the tagged Ig heavy chain polypeptide may exhibit, when the tag is converted and conjugated to a payload via fGly of the converted tag, a proportion of antibody monomers in solution of about 70% or greater, e.g., about 80% or greater, about 90% or greater, including about 95% or greater.

In certain embodiments, an antibody of the present disclosure, when the tag is converted, provides for a conjugation efficiency (e.g., DAR) of about 1.6 or greater. In some embodiments, the antibody provides for an antibody titer of about 200 mg/L or greater. An antibody conjugate that includes a payload conjugated to the present antibody via an fGly of a converted tag in the $C_H1$ domain of the Ig heavy chain polypeptide constant region may exhibit in solution a proportion of antibody monomers of about 80% or greater. In some embodiments, the antibody includes a tagged Ig heavy chain polypeptide, where the tag contains an amino acid sequence of the formula $X^1Z^1X^2Z^2X^3Z^3$, where $X^1$, $X^2$, $X^3$, $Z^1$, $Z^2$ and $Z^3$ are as described above (in ", and where the Ig heavy chain polypeptide includes a constant region containing any one or more (e.g., two or more, including three or more) of the amino acid sequences set forth in SEQ ID NOs:181, 182, 184, 186, 195-201, 206-212, 214, 216-220, 223-228, 231-241, and 244-250 of Table 1. In some embodiments, $Z^3$ is arginine. In some embodiments, $X^1$ is glycine, leucine, isoleucine, methionine, histidine, tyrosine, valine, serine, cysteine or threonine. In some embodiments, $X^2$ and $X^3$ are each independently serine, threonine, alanine, valine, glycine or cysteine. In some embodiments, the tag includes the amino acid sequence LCTPSR (SEQ ID NO:561).

The tag may be positioned between two consecutive amino acids in the $C_H1$ domain of the constant region of a corresponding parent Ig heavy chain polypeptide, e.g., the Ig heavy chain polypeptide without the tag in the constant region. Thus, the position of the tag in the Ig heavy chain amino acid sequence may be defined by the position of the most N-terminal amino acid of the amino acid sequence flanking the tag at its C-terminal end. In some embodiments, the tag is positioned adjacent and N-terminal to an amino acid residue of the Ig heavy chain polypeptide constant region (e.g., IgG1, IgG2, IgG3 or IgG4 constant region) corresponding to one or more (e.g., two or more, including three or more) of residues 4, 5, 8, 14, 21-26, 44-50, 52, 60-64, 70-75, 77-83, and 89-95, of SEQ ID NO:1.

The parent Ig heavy chain polypeptide may be modified to insert the tag in the amino acid sequence of the constant region in the $C_H1$ domain such that an antibody that includes the tag in its Ig heavy chain polypeptide, when the tag is converted, achieves a conjugation efficiency expressed as the payload to antibody ratio (e.g., drug to antibody ratio) of about 1.6 or greater. In some embodiments, the antibody achieves an antibody titer of about 200 mg/L or greater; and/or when the tag is converted and conjugated to a payload via fGly of the converted tag, a proportion of antibody monomers in solution of about 80% or greater. Insertion sites of interest in an Ig heavy chain polypeptide (e.g., IgG1, IgG2, IgG3 or IgG4 constant region polypeptide) include the position immediately N-terminal to an amino acid residue corresponding to one or more (e.g., two or more, including three or more) of positions 4, 5, 8, 14, 21-26, 44-50, 52, 60-64, 70-75, 77-83, and 89-95, of SEQ ID NO:1.

In certain embodiments, an antibody of the present disclosure includes an Ig heavy chain polypeptide containing an amino acid sequence at least 90%, e.g., at least 95%, at least 97%, at least 99%, including 100% identical to any one of the sequences set forth in SEQ ID NOs:7, 8, 10, 12, 19-24, 29-35, 37, 39-43, 46-51, 53-59, and 62-68, shown in Table 7 in FIG. 15, where the amino acid sequence includes the tag, i.e., the FGE substrate motif: LCTPSR (SEQ ID NO:561) in the constant region $C_H1$ domain. In certain embodiments, the present antibody having the tagged Ig heavy chain polypeptide may exhibit an antibody titer of about 200 mg/L or greater, e.g., about 300 mg/L or greater, about 400 mg/L or greater, about 500 mg/L or greater, or about 600 mg/L or greater. The present antibody having the tagged Ig heavy chain polypeptide may exhibit, when the tag is converted, a conjugation efficiency (e.g., DAR) of about 1.6 or greater, or about 1.7 or greater. In some embodiments, the present antibody having the tagged Ig heavy chain polypeptide may exhibit, when the tag is converted and conjugated to a payload via fGly of the converted tag, a proportion of antibody monomers in solution of about 80% or greater, e.g., about 90% or greater, including about 95% or greater.

In certain embodiments, an antibody of the present disclosure, when the tag is converted, provides for a conjugation efficiency (e.g., DAR) of about 1.7 or greater. In some embodiments, the antibody provides for an antibody titer of about 200 mg/L or greater. An antibody conjugate that includes a payload conjugated to the present antibody via an fGly of a converted tag in the $C_H1$ domain of the Ig heavy chain polypeptide constant region may exhibit in solution a proportion of antibody monomers of about 80% or greater. In some embodiments, the antibody includes a tagged Ig heavy chain polypeptide, where the tag contains an amino acid sequence of the formula $X^1Z^1X^2Z^2X^3Z^3$, where $X^1$, $X^2$, $X^3$, $Z^1$, $Z^2$ and $Z^3$ are as described above (in ", and where the Ig heavy chain polypeptide includes a constant region containing any one or more (e.g., two or more, including three or more) of the amino acid sequences set forth in SEQ ID NOs:197-200, 206, 208-211, 216, 218-220, 223-228, 231-241, 246, 248, and 249 of Table 1. In some embodiments, $Z^3$ is arginine. In some embodiments, $X^1$ is glycine, leucine, isoleucine, methionine, histidine, tyrosine, valine, serine, cysteine or threonine. In some embodiments, $X^2$ and $X^3$ are each independently serine, threonine, alanine, valine, glycine or cysteine. In some embodiments, the tag includes the amino acid sequence LCTPSR (SEQ ID NO:561).

The tag may be positioned between two consecutive amino acids in the $C_H1$ domain of the constant region of a corresponding parent Ig heavy chain polypeptide, e.g., the Ig heavy chain polypeptide without the tag in the constant region. Thus, the position of the tag in the Ig heavy chain amino acid sequence may be defined by the position of the most N-terminal amino acid of the amino acid sequence flanking the tag at its C-terminal end. In some embodiments, the tag is positioned adjacent and N-terminal to an amino acid residue of the Ig heavy chain polypeptide constant region (e.g., IgG1, IgG2, IgG3 or IgG4 constant region) corresponding to one or more (e.g., two or more, including three or more) of residues 22-25, 44, 46-49, 60, 62-64, 70-75, 77-83, 91, 93, and 94, of SEQ ID NO:1.

The parent Ig heavy chain polypeptide may be modified to insert the tag in the amino acid sequence of the constant region in the $C_H1$ domain such that an antibody that includes the tag in its Ig heavy chain polypeptide, when the tag is converted, achieves a conjugation efficiency expressed as the payload to antibody ratio (e.g., drug to antibody ratio) of about 1.7 or greater. In some embodiments, the antibody achieves an antibody titer of about 200 mg/L or greater; and/or when the tag is converted and conjugated to a payload via fGly of the converted tag, a proportion of antibody monomers in solution of about 80% or greater. Insertion sites of interest in an Ig heavy chain polypeptide (e.g., IgG1, IgG2, IgG3 or IgG4 constant region polypeptide) include the position immediately N-terminal to an amino acid residue corresponding to one or more (e.g., two or more, including three or more) of positions 22-25, 44, 46-49, 60, 62-64, 70-75, 77-83, 91, 93, and 94, of SEQ ID NO:1.

In certain embodiments, an antibody of the present disclosure includes an Ig heavy chain polypeptide containing an amino acid sequence at least 90%, e.g., at least 95%, at least 97%, at least 99%, including 100% identical to any one of the sequences set forth in SEQ ID NOs:20-23, 29, 31-34, 39, 41-43, 46-51, 53-59, 64, 66 and 67, shown in Table 7 in FIG. 15, where the amino acid sequence includes the tag, i.e., the FGE substrate motif: LCTPSR (SEQ ID NO:561) in the constant region $C_H1$ domain. In certain embodiments, the present antibody having the tagged Ig heavy chain polypeptide may exhibit an antibody titer of about 200 mg/L or greater, e.g., about 300 mg/L or greater, about 400 mg/L or greater, about 500 mg/L or greater, or about 600 mg/L or greater. The present antibody having the tagged Ig heavy chain polypeptide may exhibit, when the tag is converted, a conjugation efficiency (e.g., DAR) of about 1.6 or greater, or about 1.7 or greater. In some embodiments, the present antibody having the tagged Ig heavy chain polypeptide may exhibit, when the tag is converted and conjugated to a payload via fGly of the converted tag, a proportion of antibody monomers in solution of about 80% or greater, e.g., about 90% or greater, including about 95% or greater.

In certain embodiments, an antibody of the present disclosure, when the tag is converted, provides for a conjugation efficiency (e.g., DAR) of about 1.7 or greater. In some embodiments, the antibody provides for an antibody titer of about 600 mg/L or greater. An antibody conjugate that includes a payload conjugated to the present antibody via an fGly of a converted tag in the $C_H1$ domain of the Ig heavy chain polypeptide constant region may exhibit in solution a proportion of antibody monomers of about 90% or greater. In some embodiments, the antibody includes a tagged Ig heavy chain polypeptide, where the tag contains an amino acid sequence of the formula $X^1Z^1X^2Z^2X^3Z^3$, where $X^1$, $X^2$, $X^3$, $Z^1$, $Z^2$ and $Z^3$ are as described above (in ", and where the Ig heavy chain polypeptide includes a constant region containing any one or more (e.g., two or more, including three or more) of the amino acid sequences set forth in SEQ ID NOs:197-199, 216, 218, 232-235, and 238-240, in Table 1. In some embodiments, $Z^3$ is arginine. In some embodiments, $X^1$ is glycine, leucine, isoleucine, methionine, histidine, tyrosine, valine, serine, cysteine or threonine. In some embodiments, $X^2$ and $X^3$ are each independently serine, threonine, alanine, valine, glycine or cysteine. In some embodiments, the tag includes the amino acid sequence LCTPSR (SEQ ID NO:561).

The tag may be positioned between two consecutive amino acids in the $C_H1$ domain of the constant region of a corresponding parent Ig heavy chain polypeptide, e.g., the Ig heavy chain polypeptide without the tag in the constant region. Thus, the position of the tag in the Ig heavy chain amino acid sequence may be defined by the position of the most N-terminal amino acid of the amino acid sequence flanking the tag at its C-terminal end. In some embodiments, the tag is positioned adjacent and N-terminal to an amino acid residue of the Ig heavy chain polypeptide constant region (e.g., IgG1, IgG2, IgG3 or IgG4 constant region) corresponding to one or more (e.g., two or more, including three or more) of residues 22-24, 60, 62, 78, 79, 81, and 82, of SEQ ID NO:1.

The parent Ig heavy chain polypeptide may be modified to insert the tag in the amino acid sequence of the constant region in the $C_H1$ domain such that an antibody that includes the tag in its Ig heavy chain polypeptide, when the tag is converted, achieves a conjugation efficiency expressed as the payload to antibody ratio (e.g., drug to antibody ratio) of about 1.7 or greater. In some embodiments, the antibody achieves an antibody titer of about 600 mg/L or greater; and/or when the tag is converted and conjugated to a payload via fGly of the converted tag, a proportion of antibody monomers in solution of about 90% or greater. Insertion sites of interest in an Ig heavy chain polypeptide (e.g., IgG1, IgG2, IgG3 or IgG4 constant region polypeptide) include the position immediately N-terminal to an amino acid residue corresponding to one or more (e.g., two or more, including three or more) of positions 22-24, 60, 62, 78, 79, 81, and 82, of SEQ ID NO:1.

In certain embodiments, an antibody of the present disclosure includes an Ig heavy chain polypeptide containing an amino acid sequence at least 90%, e.g., at least 95%, at least 97%, at least 99%, including 100% identical to any one of the sequences set forth in SEQ ID NOs:20-22, 39, 41, 54, 55, 57 and 58, shown in Table 7 in FIG. 15, where the amino acid sequence includes the tag, i.e., the FGE substrate motif: LCTPSR (SEQ ID NO:561) in the constant region $C_H1$ domain. The present antibody having the tagged Ig heavy chain polypeptide may exhibit an antibody titer of about 600 mg/L or greater. The present antibody having the tagged Ig heavy chain polypeptide may exhibit, when the tag is converted, a conjugation efficiency (e.g., DAR) of about 1.7 or greater. In some embodiments, the present antibody having the tagged Ig heavy chain polypeptide may exhibit, when the tag is converted and conjugated to a payload via fGly of the converted tag, a proportion of antibody monomers in solution of about 90% or greater, or about 95% or greater.

Antibodies Having a Tag in a Hinge Domain of an Ig Heavy Chain Constant Region

In some cases, an antibody of the present disclosure includes a tag in the hinge domain of an Ig heavy chain polypeptide constant region. The antibody may include a tag having an amino acid sequence of the formula $X^1Z^1X^2Z^2X^3Z^3$, where $X^1$, $X^2$, $X^3$, $Z^1$, $Z^2$ and $Z^3$ are as described above (in ", and where the Ig heavy chain polypeptide includes a constant region containing, in the hinge domain, any one or more (e.g., two or more, or three or more) of the amino acid sequences set forth in SEQ ID NOs:252-264, shown in Table 2. In some embodiments, the antibody provides for an antibody titer of about 600 mg/L or greater. In some cases, the antibody, when the tag is converted, provides for a conjugation efficiency, represented by the average molar ratio of payload to antibody (PAR, e.g., drug-to-antibody ratio (DAR)), of about 0.5 or greater. An antibody conjugate that includes a payload conjugated to the present antibody via an fGly of a converted tag in the hinge domain of the Ig heavy chain polypeptide constant region may exhibit in solution a proportion of antibody monomers of about 70% or greater. In some embodiments, $Z^3$ is arginine. In some embodiments, $X^1$ is glycine, leucine, isoleucine, methionine, histidine, tyrosine, valine, serine, cysteine or threonine. In some embodiments, $X^2$ and $X^3$ are each independently serine, threonine, alanine, valine, glycine or cysteine. In some embodiments, the tag includes the amino acid sequence LCTPSR (SEQ ID NO:561).

TABLE 2

| Position | Sequence | SEQ ID NO: |
|---|---|---|
| 100P | VEX$^1$Z$^1$X$^2$Z$^2$X$^3$Z$^3$PKS | 252 |
| 101K | VEPX$^1$Z$^1$X$^2$Z$^2$X$^3$Z$^3$KSC | 253 |
| 102S | PKX$^1$Z$^1$X$^2$Z$^2$X$^3$Z$^3$SCD | 254 |
| 103C | PKSX$^1$Z$^1$X$^2$Z$^2$X$^3$Z$^3$CD | 255 |
| 104D | SCX$^1$Z$^1$X$^2$Z$^2$X$^3$Z$^3$DKT | 256 |
| 105K | CDX$^1$Z$^1$X$^2$Z$^2$X$^3$Z$^3$KTH | 257 |
| 106T | CDKX$^1$Z$^1$X$^2$Z$^2$X$^3$Z$^3$TH | 258 |
| 107H | KTX$^1$Z$^1$X$^2$Z$^2$X$^3$Z$^3$HT | 259 |
| 108T | THX$^1$Z$^1$X$^2$Z$^2$X$^3$Z$^3$TCP | 260 |
| 109C | THTX$^1$Z$^1$X$^2$Z$^2$X$^3$Z$^3$CPP | 261 |
| 110P | TCX$^1$Z$^1$X$^2$Z$^2$X$^3$Z$^3$PPC | 262 |
| 112C | PPX$^1$Z$^1$X$^2$Z$^2$X$^3$Z$^3$CP | 263 |
| 113P | PCX$^1$Z$^1$X$^2$Z$^2$X$^3$Z$^3$PAPE | 264 |

As described above, the tag may be positioned between two consecutive amino acids in the hinge domain of the constant region of a corresponding parent Ig heavy chain polypeptide, e.g., the Ig heavy chain polypeptide without the tag in the constant region. Thus, the position of the tag in the Ig heavy chain amino acid sequence may be defined by the position of the most N-terminal amino acid of the amino acid sequence flanking the tag at its C-terminal end. In some embodiments, the tag is positioned adjacent and N-terminal to an amino acid residue of the Ig heavy chain polypeptide constant region (e.g., IgG1 constant region) corresponding to one or more (e.g., two or more, including three or more) of residues 100-110, 112, or 113 of SEQ ID NO:1.

The parent Ig heavy chain polypeptide may be modified to insert the tag in the amino acid sequence of the constant region in the hinge domain such that an antibody that includes the tag in its Ig heavy chain polypeptide, when the tag is converted, achieves a conjugation efficiency expressed as the payload to antibody ratio (e.g., drug to antibody ratio) of about 0.5 or greater. In some embodiments, the antibody achieves an antibody titer of about 600 mg/L or greater; and/or when the tag is converted and conjugated to a payload via fGly of the converted tag, a proportion of antibody monomers in solution of about 70% or greater. Insertion sites of interest in an Ig heavy chain polypeptide (e.g., IgG1 constant region polypeptide) include the position immediately N-terminal to an amino acid residue corresponding to one or more (e.g., two or more, including three or more) of positions 100-110, 112, or 113, of SEQ ID NO:1.

In certain embodiments, an antibody of the present disclosure includes an Ig heavy chain polypeptide containing an amino acid sequence at least 90%, e.g., at least 95%, at least 97%, at least 99%, including 100% identical to any one of the sequences set forth in SEQ ID NOs:70-82, shown in Table 8 in FIG. 16, where the amino acid sequence includes the tag, i.e., the FGE substrate motif: LCTPSR (SEQ ID NO:561) in the constant region hinge domain. In certain embodiments, the present antibody having the tagged Ig heavy chain polypeptide may exhibit an antibody titer of about 600 mg/L or greater, e.g., about 650 mg/L or greater, about 700 mg/L or greater, about 800 mg/L or greater, or about 1,000 mg/L or greater. In some embodiments, the present antibody having the tagged Ig heavy chain polypeptide may exhibit, when the tag is converted, a conjugation efficiency (e.g., DAR) of about 0.5 or greater, e.g., about 1.0 or greater, or about 1.6 or greater, or about 1.7 or greater. In some embodiments, the present antibody having the tagged Ig heavy chain polypeptide may exhibit, when the tag is converted and conjugated to a payload via fGly of the converted tag, a proportion of antibody monomers in solution of about 70% or greater, e.g., about 80% or greater, about 90% or greater, including about 95% or greater.

In certain embodiments, an antibody of the present disclosure, when the tag is converted, provides for a conjugation efficiency (e.g., DAR) of about 1.0 or greater. In some embodiments, the antibody provides for an antibody titer of about 600 mg/L or greater. An antibody conjugate that includes a payload conjugated to the present antibody via an fGly of a converted tag in the hinge domain of the Ig heavy chain polypeptide constant region may exhibit in solution a proportion of antibody monomers of about 70% or greater. In some embodiments, the antibody includes a tagged Ig heavy chain polypeptide, where the tag contains an amino acid sequence of the formula $X^1Z^1X^2Z^2X^3Z^3$, where $X^1$, $X^2$, $X^3$, $Z^1$, $Z^2$ and $Z^3$ are as described above (in ", and where the Ig heavy chain polypeptide includes a constant region containing any one or more (e.g., two or more, including three or more) of the amino acid sequences set forth in SEQ ID NOs:254-256 and 258-264 of Table 2. In some embodiments, $Z^3$ is arginine. In some embodiments, $X^1$ is glycine, leucine, isoleucine, methionine, histidine, tyrosine, valine, serine, cysteine or threonine. In some embodiments, $X^2$ and $X^3$ are each independently serine, threonine, alanine, valine, glycine or cysteine. In some embodiments, the tag includes the amino acid sequence LCTPSR (SEQ ID NO:561).

The tag may be positioned between two consecutive amino acids in the hinge domain of the constant region of a corresponding parent Ig heavy chain polypeptide, e.g., the Ig heavy chain polypeptide without the tag in the constant region. Thus, the position of the tag in the Ig heavy chain amino acid sequence may be defined by the position of the most N-terminal amino acid of the amino acid sequence flanking the tag at its C-terminal end. In some embodiments, the tag is positioned adjacent and N-terminal to an amino acid residue of the Ig heavy chain polypeptide constant region (e.g., IgG1 constant region) corresponding to one or more (e.g., two or more, including three or more) of residues 102-104, 106-110, 112, and 113, of SEQ ID NO:1.

The parent Ig heavy chain polypeptide may be modified to insert the tag in the amino acid sequence of the constant region in the hinge domain such that an antibody that includes the tag in its Ig heavy chain polypeptide, when the tag is converted, achieves a conjugation efficiency expressed as the payload to antibody ratio (e.g., drug to antibody ratio) of about 1.0 or greater. In some embodiments, the antibody achieves an antibody titer of about 600 mg/L or greater; and/or when the tag is converted and conjugated to a payload via fGly of the converted tag, a proportion of antibody monomers in solution of about 70% or greater. Insertion sites of interest in an Ig heavy chain polypeptide (e.g., IgG1 constant region polypeptide) include the position immediately N-terminal to an amino acid residue corresponding to one or more (e.g., two or more, including three or more) of positions 102-104, 106-110, 112, and 113, of SEQ ID NO:1.

In certain embodiments, an antibody of the present disclosure includes an Ig heavy chain polypeptide containing an amino acid sequence at least 90%, e.g., at least 95%, at least 97%, at least 99%, including 100% identical to any one of the sequences set forth in SEQ ID NOs:72-74 and 76-82, shown in Table 8 in FIG. 16, where the amino acid sequence includes the tag, i.e., the FGE substrate motif: LCTPSR (SEQ ID NO:561) in the constant region hinge domain. In certain embodiments, the present antibody having the tagged Ig heavy chain polypeptide may exhibit an antibody titer of about 600 mg/L or greater, e.g., about 650 mg/L or greater, about 700 mg/L or greater, about 800 mg/L or greater, or about 1,000 mg/L or greater. In some embodiments, the present antibody having the tagged Ig heavy chain polypeptide may exhibit, when the tag is converted, a conjugation efficiency (e.g., DAR) of about 1.0 or greater, about 1.6 or greater, or about 1.7 or greater. In some embodiments, the present antibody having the tagged Ig heavy chain polypeptide may exhibit, when the tag is converted and conjugated to a payload via fGly of the converted tag, a proportion of antibody monomers in solution of about 70% or greater, e.g., about 80% or greater, about 90% or greater, including about 95% or greater.

In certain embodiments, an antibody of the present disclosure, when the tag is converted, provides for a conjugation efficiency (e.g., DAR) of about 1.6 or greater. In some embodiments, the antibody provides for an antibody titer of about 600 mg/L or greater. An antibody conjugate that includes a payload conjugated to the present antibody via an fGly of a converted tag in the hinge domain of the Ig heavy chain polypeptide constant region may exhibit in solution a proportion of antibody monomers of about 70% or greater. In some embodiments, the antibody includes a tagged Ig heavy chain polypeptide, where the tag contains an amino acid sequence of the formula $X^1Z^1X^2Z^2X^3Z^3$, where $X^1$, $X^2$, $X^3$, $Z^1$, $Z^2$ and $Z^3$ are as described above (in ", and where the Ig heavy chain polypeptide includes a constant region containing any one or more (e.g., two or more, including three or more) of the amino acid sequences set forth in SEQ ID NOs:258-263 of Table 2. In some embodiments, $Z^3$ is arginine. In some embodiments, $X^1$ is glycine, leucine, isoleucine, methionine, histidine, tyrosine, valine, serine, cysteine or threonine. In some embodiments, $X^2$ and $X^3$ are each independently serine, threonine, alanine, valine, glycine or cysteine. In some embodiments, the tag includes the amino acid sequence LCTPSR (SEQ ID NO:561).

The tag may be positioned between two consecutive amino acids in the hinge domain of the constant region of a corresponding parent Ig heavy chain polypeptide, e.g., the Ig heavy chain polypeptide without the tag in the constant region. Thus, the position of the tag in the Ig heavy chain amino acid sequence may be defined by the position of the most N-terminal amino acid of the amino acid sequence flanking the tag at its C-terminal end. In some embodiments, the tag is positioned adjacent and N-terminal to an amino acid residue of the Ig heavy chain polypeptide constant region (e.g., IgG1 constant region) corresponding to one or more (e.g., two or more, including three or more) of residues 106-110, and 112, of SEQ ID NO:1.

The parent Ig heavy chain polypeptide may be modified to insert the tag in the amino acid sequence of the constant region in the hinge domain such that an antibody that includes the tag in its Ig heavy chain polypeptide, when the tag is converted, achieves a conjugation efficiency expressed as the payload to antibody ratio (e.g., drug to antibody ratio) of about 1.6 or greater. In some embodiments, the antibody achieves an antibody titer of about 600 mg/L or greater; and/or when the tag is converted and conjugated to a payload via fGly of the converted tag, a proportion of antibody monomers in solution of about 70% or greater. Insertion sites of interest in an Ig heavy chain polypeptide (e.g., IgG1 constant region polypeptide) include the position immediately N-terminal to an amino acid residue corresponding to one or more (e.g., two or more, including three or more) of positions 106-110, and 112, of SEQ ID NO:1.

In certain embodiments, an antibody of the present disclosure includes an Ig heavy chain polypeptide containing an amino acid sequence at least 90%, e.g., at least 95%, at least 97%, at least 99%, including 100% identical to any one of the sequences set forth in SEQ ID NOs:76-81, shown in Table 8 in FIG. 16, where the amino acid sequence includes the tag, i.e., the FGE substrate motif: LCTPSR (SEQ ID NO:561) in the constant region hinge domain. In certain embodiments, the present antibody having the tagged Ig heavy chain polypeptide may exhibit an antibody titer of about 600 mg/L or greater, e.g., about 650 mg/L or greater, about 700 mg/L or greater, about 800 mg/L or greater, or about 1,000 mg/L or greater. In some embodiments, the present antibody having the tagged Ig heavy chain polypeptide may exhibit, when the tag is converted, a conjugation efficiency (e.g., DAR) of about 1.6 or greater, or about 1.7 or greater. In some embodiments, the present antibody having the tagged Ig heavy chain polypeptide may exhibit, when the tag is converted and conjugated to a payload via fGly of the converted tag, a proportion of antibody monomers in solution of about 70% or greater, e.g., about 80% or greater, about 90% or greater, including about 95% or greater.

In certain embodiments, an antibody of the present disclosure, when the tag is converted, provides for a conjugation efficiency (e.g., DAR) of about 1.7 or greater. In some embodiments, the antibody provides for an antibody titer of about 600 mg/L or greater. An antibody conjugate that includes a payload conjugated to the present antibody via an fGly of a converted tag in the hinge domain of the Ig heavy chain polypeptide constant region may exhibit in solution a proportion of antibody monomers of about 70% or greater. In some embodiments, the antibody includes a tagged Ig heavy chain polypeptide, where the tag contains an amino acid sequence of the formula $X^1Z^1X^2Z^2X^3Z^3$, where $X^1$, $X^2$, $X^3$, $Z^1$, $Z^2$ and $Z^3$ are as described above (in ", and where the Ig heavy chain polypeptide includes a constant region containing any one or more (e.g., two or more, including three or more) of the amino acid sequences set forth in SEQ ID NOs:258, 259, 261 or 263 of Table 2. In some embodiments, $Z^3$ is arginine. In some embodiments, $X^1$ is glycine, leucine, isoleucine, methionine, histidine, tyrosine, valine, serine, cysteine or threonine. In some embodiments, $X^2$ and $X^3$ are each independently serine, threonine, alanine, valine, glycine or cysteine. In some embodiments, the tag includes the amino acid sequence LCTPSR (SEQ ID NO:561).

The tag may be positioned between two consecutive amino acids in the hinge domain of the constant region of a corresponding parent Ig heavy chain polypeptide, e.g., the Ig heavy chain polypeptide without the tag in the constant region. Thus, the position of the tag in the Ig heavy chain amino acid sequence may be defined by the position of the most N-terminal amino acid of the amino acid sequence flanking the tag at its C-terminal end. In some embodiments, the tag is positioned adjacent and N-terminal to an amino acid residue of the Ig heavy chain polypeptide constant region (e.g., IgG1 constant region) corresponding to one or more (e.g., two or more, including three or more) of residues 106, 107, 109, and 112, of SEQ ID NO:1.

The parent Ig heavy chain polypeptide may be modified to insert the tag in the amino acid sequence of the constant region in the hinge domain such that an antibody that includes the tag in its Ig heavy chain polypeptide, when the tag is converted, achieves a conjugation efficiency expressed as the payload to antibody ratio (e.g., drug to antibody ratio) of about 1.7 or greater. In some embodiments, the antibody achieves an antibody titer of about 600 mg/L or greater; and/or when the tag is converted and conjugated to a payload via fGly of the converted tag, a proportion of antibody monomers in solution of about 70% or greater. Insertion sites of interest in an Ig heavy chain polypeptide (e.g., IgG1 constant region polypeptide) include the position immediately N-terminal to an amino acid residue corresponding to one or more (e.g., two or more, including three or more) of positions 106, 107, 109, and 112, of SEQ ID NO:1.

In certain embodiments, an antibody of the present disclosure includes an Ig heavy chain polypeptide containing an amino acid sequence at least 90%, e.g., at least 95%, at least 97%, at least 99%, including 100% identical to any one of the sequences set forth in SEQ ID NOs:76, 77, 79 and 81, shown in Table 8 in FIG. 16, where the amino acid sequence includes the tag, i.e., the FGE substrate motif: LCTPSR (SEQ ID NO:561) in the constant region hinge domain. In certain embodiments, the present antibody having the tagged Ig heavy chain polypeptide may exhibit an antibody titer of about 600 mg/L or greater, e.g., about 650 mg/L or greater, about 700 mg/L or greater, about 800 mg/L or greater, or about 1,000 mg/L or greater. In some embodiments, the present antibody having the tagged Ig heavy chain polypeptide may exhibit, when the tag is converted, a conjugation efficiency (e.g., DAR) of about 1.7 or greater. In some embodiments, the present antibody having the tagged Ig heavy chain polypeptide may exhibit, when the tag is converted and conjugated to a payload via fGly of the converted tag, a proportion of antibody monomers in solution of about 70% or greater, e.g., about 80% or greater, about 90% or greater, including about 95% or greater.

Antibodies Having a Tag in a $C_H2$ Domain of an Ig Heavy Chain Constant Region

In some embodiments, an antibody of the present disclosure includes a tag in the $C_H2$ domain of an Ig heavy chain polypeptide constant region. Thus, the antibody may include a tag having an amino acid sequence of the formula $X^1Z^1X^2Z^2X^3Z^3$, where $X^1$, $X^2$, $X^3$, $Z^1$, $Z^2$ and $Z^3$ are as described above (in ", and where the Ig heavy chain polypeptide includes a constant region containing, in the $C_H2$ domain, any one or more (e.g., two or more, or three or more) of the amino acid sequences set forth in SEQ ID NOs:265-307, shown in Table 3. In some embodiments, the antibody provides for an antibody titer of about 100 mg/L or greater. In some cases, the antibody, when the tag is converted, as described herein, may provide for a conjugation efficiency, represented by the average molar ratio of payload to antibody (PAR, e.g., drug-to-antibody ratio (DAR)), of about 0.5 or greater. An antibody conjugate that includes a payload conjugated to the present antibody via an fGly of a converted tag in the $C_H2$ domain of the Ig heavy chain polypeptide constant region, as described below, may exhibit in solution a proportion of antibody monomers of about 30% or greater. In some embodiments, $Z^3$ is arginine. In some embodiments, $X^1$ is glycine, leucine, isoleucine, methionine, histidine, tyrosine, valine, serine, cysteine or threonine. In some embodiments, $X^2$ and $X^3$ are each independently serine, threonine, alanine, valine, glycine or cysteine. In some embodiments, the tag includes the amino acid sequence LCTPSR (SEQ ID NO:561).

TABLE 3

| Position | Sequence | SEQ ID NO: |
|---|---|---|
| 114A | PCPX$^1$Z$^1$X$^2$Z$^2$X$^3$Z$^3$AP[E/P] | 265 |
| 114A | SCPX$^1$Z$^1$X$^2$Z$^2$X$^3$Z$^3$APE | 266 |
| 115P | CPAX$^1$Z$^1$X$^2$Z$^2$X$^3$Z$^3$P[EL/EF/PV] | 267 |
| 116E | CPAPX$^1$Z$^1$X$^2$Z$^2$X$^3$Z$^3$E[L/F]L | 268 |
| 116P | CPAPX$^1$Z$^1$X$^2$Z$^2$X$^3$Z$^3$PVA | 269 |
| 118L | PE[L/F]X$^1$Z$^1$X$^2$Z$^2$X$^3$Z$^3$LGG | 270 |
| 119G | [L/F]LX$^1$Z$^1$X$^2$Z$^2$X$^3$Z$^3$GG | 271 |
| 121P | [LG/VA]GX$^1$Z$^1$X$^2$Z$^2$X$^3$Z$^3$PSV | 272 |
| 122S | [G/A]GPX$^1$Z$^1$X$^2$Z$^2$X$^3$Z$^3$SVF | 273 |
| 138R | ISX$^1$Z$^1$X$^2$Z$^2$X$^3$Z$^3$RT | 274 |
| 139T | ISRX$^1$Z$^1$X$^2$Z$^2$X$^3$Z$^3$TPE | 275 |
| 140P | RTX$^1$Z$^1$X$^2$Z$^2$X$^3$Z$^3$PEVT | 276 |
| 150S | DVX$^1$Z$^1$X$^2$Z$^2$X$^3$Z$^3$[H--/QED] | 277 |
| 151H | DVSX$^1$Z$^1$X$^2$Z$^2$X$^3$Z$^3$[H/Q]ED | 278 |
| 152E | [-SH/VSQ]X$^1$Z$^1$X$^2$Z$^2$X$^3$Z$^3$ED | 279 |
| 153D | [H/Q]EX$^1$Z$^1$X$^2$Z$^2$X$^3$Z$^3$DP | 280 |
| 154P | EDX$^1$Z$^1$X$^2$Z$^2$X$^3$Z$^3$PEV | 281 |
| 155E | DPX$^1$Z$^1$X$^2$Z$^2$X$^3$Z$^3$EV[K/Q] | 282 |
| 158F | EVKX$^1$Z$^1$X$^2$Z$^2$X$^3$Z$^3$FN | 283 |
| 158F | EVQX$^1$Z$^1$X$^2$Z$^2$X$^3$Z$^3$F[NW/K-] | 284 |
| 167V | GVEX$^1$Z$^1$X$^2$Z$^2$X$^3$Z$^3$VHN | 285 |
| 168H | VEVX$^1$Z$^1$X$^2$Z$^2$X$^3$Z$^3$HNA | 286 |
| 169N | EVHX$^1$Z$^1$X$^2$Z$^2$X$^3$Z$^3$NA | 287 |
| 170A | HNX$^1$Z$^1$X$^2$Z$^2$X$^3$Z$^3$AKT | 288 |
| 171K | NAX$^1$Z$^1$X$^2$Z$^2$X$^3$Z$^3$KTKP | 289 |
| 172T | AKX$^1$Z$^1$X$^2$Z$^2$X$^3$Z$^3$TKP | 290 |
| 179Y | EQX$^1$Z$^1$X$^2$Z$^2$X$^3$Z$^3$[YNS/FN-] | 291 |

TABLE 3-continued

| Position | Sequence | SEQ ID NO: |
|---|---|---|
| 183Y | NSTX$Z^1$X$^2$Z$^2$X$^3$Z$^3$[Y/F]R | 292 |
| 184R | ST[Y/F]X$^1$Z$^1$X$^2$Z$^2$X$^3$Z$^3$RV | 293 |
| 185V | [Y/F]RX$^1$Z$^1$X$^2$Z$^2$X$^3$Z$^3$VVS | 294 |
| 186V | [Y/F]RVX$^1$Z$^1$X$^2$Z$^2$X$^3$Z$^3$VSV | 295 |
| 187S | RVVX$^1$Z$^1$X$^2$Z$^2$X$^3$Z$^3$SVL | 296 |
| 209K | VSNX$^1$Z$^1$X$^2$Z$^2$X$^3$Z$^3$K[A/G]L | 297 |
| 210A | NKX$^1$Z$^1$X$^2$Z$^2$X$^3$Z$^3$[ALP/GL-] | 298 |
| 211L | KAX$^1$Z$^1$X$^2$Z$^2$X$^3$Z$^3$LPA | 299 |
| 211L | NKGX$^1$Z$^1$X$^2$Z$^2$X$^3$Z$^3$LP[A/S] | 300 |
| 213A | ALPX$^1$Z$^1$X$^2$Z$^2$X$^3$Z$^3$AP | 301 |
| 213A | GLPX$^1$Z$^1$X$^2$Z$^2$X$^3$Z$^3$[AP/SS] | 302 |
| 214P | LPAX$^1$Z$^1$X$^2$Z$^2$X$^3$Z$^3$PI | 303 |
| 214S | LPSX$^1$Z$^1$X$^2$Z$^2$X$^3$Z$^3$SI | 304 |
| 215I | LP[AP/SS]X$^1$Z$^1$X$^2$Z$^2$X$^3$Z$^3$IE | 305 |
| 221K | TISX$^1$Z$^1$X$^2$Z$^2$X$^3$Z$^3$K[A-/TK] | 306 |
| 222A | ISKX$^1$Z$^1$X$^2$Z$^2$X$^3$Z$^3$[AK-/TKG] | 307 |

([*/*] denotes alternative amino acids (or amino acid sequences) chosen from the amino acid residues (or sequences) separated by "/". "-" denotes that no amino acid is required there to specify the position.)

As described above, the tag may be positioned between two consecutive amino acids in the $C_H2$ domain of the constant region of a corresponding parent Ig heavy chain polypeptide, e.g., the Ig heavy chain polypeptide without the tag in the constant region. In some cases, the tag is positioned at the N-terminal end of the $C_H2$ domain (i.e., between the hinge domain and the $C_H2$ domain of the Ig heavy chain constant region). Thus, the position of the tag in the Ig heavy chain amino acid sequence may be defined by the position of the most N-terminal amino acid of the amino acid sequence flanking the tag at its C-terminal end. In some embodiments, the tag is positioned adjacent and N-terminal to an amino acid residue of the Ig heavy chain polypeptide constant region (e.g., IgG1, IgG2, IgG3 or IgG4 constant region) corresponding to one or more (e.g., two or more, including three or more) of residues 114-116, 118, 119, 121, 122, 138-140, 150-155, 158, 167-172, 179, 183-187, 209-211, 213-215, 221, and 222 of SEQ ID NO:1.

The parent Ig heavy chain polypeptide may be modified to insert the tag in the amino acid sequence of the constant region in the $C_H2$ domain such that an antibody that includes the tag in its Ig heavy chain polypeptide, when the tag is converted, achieves a conjugation efficiency expressed as the payload to antibody ratio (e.g., drug to antibody ratio) of about 0.5 or greater. In some embodiments, the antibody achieves an antibody titer of about 100 mg/L or greater; and/or when the tag is converted and conjugated to a payload via fGly of the converted tag, a proportion of antibody monomers in solution of about 30% or greater. Insertion sites of interest in an Ig heavy chain polypeptide (e.g., IgG1, IgG2, IgG3 or IgG4 constant region polypeptide) include the position immediately N-terminal to an amino acid residue corresponding to one or more (e.g., two or more, including three or more) of positions 114-116, 118, 119, 121, 122, 138-140, 150-155, 158, 167-172, 179, 183-187, 209-211, 213-215, 221, and 222, of SEQ ID NO:1.

In certain embodiments, an antibody of the present disclosure includes an Ig heavy chain polypeptide containing an amino acid sequence at least 90%, e.g., at least 95%, at least 97%, at least 99%, including 100% identical to any one of the sequences set forth in SEQ ID NOs:83-119 shown in Table 9 in FIG. 17, where the amino acid sequence includes the tag, i.e., the FGE substrate motif: LCTPSR (SEQ ID NO:561) in the constant region $C_H2$ domain. In certain embodiments, the present antibody having the tagged Ig heavy chain polypeptide may exhibit an antibody titer of about 100 mg/L or greater, e.g., about 200 mg/L or greater, about 300 mg/L or greater, about 400 mg/L or greater, or about 500 mg/L or greater. In some embodiments, the present antibody having the tagged Ig heavy chain polypeptide may exhibit, when the tag is converted, a conjugation efficiency (e.g., DAR) of about 0.5 or greater, e.g., about 1.0 or greater, about 1.6 or greater, or about 1.7 or greater. In some embodiments, the present antibody having the tagged Ig heavy chain polypeptide may exhibit, when the tag is converted and conjugated to a payload via fGly of the converted tag, a proportion of antibody monomers in solution of about 30% or greater, e.g., about 50% or greater, about 60% or greater, about 70% or greater, about 80% or greater, about 90% or greater, including about 95% or greater.

In certain embodiments, an antibody of the present disclosure, when the tag is converted, provides for a conjugation efficiency (e.g., DAR) of about 1.0 or greater. In some embodiments, the antibody provides for an antibody titer of about 100 mg/L or greater. An antibody conjugate that includes a payload conjugated to the present antibody via an fGly of a converted tag in the $C_H2$ domain of the Ig heavy chain polypeptide constant region may exhibit in solution a proportion of antibody monomers of about 30% or greater. In some embodiments, the antibody includes a tagged Ig heavy chain polypeptide, where the tag contains an amino acid sequence of the formula X$^1$Z$^1$X$^2$Z$^2$X$^3$Z$^3$, where X$^1$, X$^2$, X$^3$, Z$^1$, Z$^2$ and Z$^3$ are as described above (in '', and where the Ig heavy chain polypeptide includes a constant region containing any one or more (e.g., two or more, including three or more) of the amino acid sequences set forth in SEQ ID NOs:265-271, 274-280, 282-291, 293-295, and 298-307 of Table 3. In some embodiments, Z$^3$ is arginine. In some embodiments, X$^1$ is glycine, leucine, isoleucine, methionine, histidine, tyrosine, valine, serine, cysteine or threonine. In some embodiments, X$^2$ and X$^3$ are each independently serine, threonine, alanine, valine, glycine or cysteine. In some embodiments, the tag includes the amino acid sequence LCTPSR (SEQ ID NO:561).

The tag may be positioned between two consecutive amino acids in the $C_H2$ domain of the constant region of a corresponding parent Ig heavy chain polypeptide, e.g., the Ig heavy chain polypeptide without the tag in the constant region. Thus, the position of the tag in the Ig heavy chain amino acid sequence may be defined by the position of the most N-terminal amino acid of the amino acid sequence flanking the tag at its C-terminal end. In some embodiments, the tag is positioned adjacent and N-terminal to an amino acid residue of the Ig heavy chain polypeptide constant region (e.g., IgG1, IgG2, IgG3 or IgG4 constant region) corresponding to one or more (e.g., two or more, including three or more) of residues 114-116, 118, 119, 138-140, 150-153, 155, 158, 167-172, 179, 184-186, 210, 211, 213-215, 221, and 222, of SEQ ID NO:1.

The parent Ig heavy chain polypeptide may be modified to insert the tag in the amino acid sequence of the constant region in the $C_H2$ domain such that an antibody that includes the tag in its Ig heavy chain polypeptide, when the tag is converted, achieves a conjugation efficiency expressed as the payload to antibody ratio (e.g., drug to antibody ratio) of about 1.0 or greater. In some embodiments, the antibody achieves an antibody titer of about 100 mg/L or greater; and/or when the tag is converted and conjugated to a payload via fGly of the converted tag, a proportion of antibody monomers in solution of about 30% or greater. Insertion sites of interest in an Ig heavy chain polypeptide (e.g., IgG1, IgG2, IgG3 or IgG4 constant region polypeptide) include the position immediately N-terminal to an amino acid residue corresponding to one or more (e.g., two or more, including three or more) of positions 114-116, 118, 119, 138-140, 150-153, 155, 158, 167-172, 179, 184-186, 210, 211, 213-215, 221, and 222, of SEQ ID NO:1.

In certain embodiments, an antibody of the present disclosure includes an Ig heavy chain polypeptide containing an amino acid sequence at least 90%, e.g., at least 95%, at least 97%, at least 99%, including 100% identical to any one of the sequences set forth in SEQ ID NOs:83-87, 90-96, 98-106, 108-110, and 113-119 shown in Table 9 in FIG. 17, where the amino acid sequence includes the tag, i.e., the FGE substrate motif: LCTPSR (SEQ ID NO:561) in the constant region $C_H2$ domain. In certain embodiments, the present antibody having the tagged Ig heavy chain polypeptide may exhibit an antibody titer of about 100 mg/L or greater, e.g., about 200 mg/L or greater, about 300 mg/L or greater, about 400 mg/L or greater, or about 500 mg/L or greater. In some embodiments, the present antibody having the tagged Ig heavy chain polypeptide may exhibit, when the tag is converted, a conjugation efficiency (e.g., DAR) of about 1.0 or greater, about 1.6 or greater, or about 1.7 or greater. In some embodiments, the present antibody having the tagged Ig heavy chain polypeptide may exhibit, when the tag is converted and conjugated to a payload via fGly of the converted tag, a proportion of antibody monomers in solution of about 30% or greater, e.g., about 50% or greater, about 60% or greater, about 70% or greater, about 80% or greater, about 90% or greater, including about 95% or greater.

In certain embodiments, an antibody of the present disclosure, when the tag is converted, provides for a conjugation efficiency (e.g., DAR) of about 1.6 or greater. In some embodiments, the antibody provides for an antibody titer of about 100 mg/L or greater. An antibody conjugate that includes a payload conjugated to the present antibody via an fGly of a converted tag in the $C_H2$ domain of the Ig heavy chain polypeptide constant region may exhibit in solution a proportion of antibody monomers of about 30% or greater. In some embodiments, the antibody includes a tagged Ig heavy chain polypeptide, where the tag contains an amino acid sequence of the formula $X^1Z^1X^2Z^2X^3Z^3$, where $X^1$, $X^2$, $X^3$, $Z^1$, and $Z^3$ are as described above (in ", and where the Ig heavy chain polypeptide includes a constant region containing any one or more (e.g., two or more, including three or more) of the amino acid sequences set forth in SEQ ID NOs:267-269, 274-276, 278-280, 282-286, 288-290, 294, and 301-304 of Table 3. In some embodiments, $Z^3$ is arginine. In some embodiments, $X^1$ is glycine, leucine, isoleucine, methionine, histidine, tyrosine, valine, serine, cysteine or threonine. In some embodiments, $X^2$ and $X^3$ are each independently serine, threonine, alanine, valine, glycine or cysteine. In some embodiments, the tag includes the amino acid sequence LCTPSR (SEQ ID NO:561).

The tag may be positioned between two consecutive amino acids in the $C_H2$ domain of the constant region of a corresponding parent Ig heavy chain polypeptide, e.g., the Ig heavy chain polypeptide without the tag in the constant region. Thus, the position of the tag in the Ig heavy chain amino acid sequence may be defined by the position of the most N-terminal amino acid of the amino acid sequence flanking the tag at its C-terminal end. In some embodiments, the tag is positioned adjacent and N-terminal to an amino acid residue of the Ig heavy chain polypeptide constant region (e.g., IgG1, IgG2, IgG3 or IgG4 constant region) corresponding to one or more (e.g., two or more, including three or more) of residues 115, 116, 138-140, 151-153, 155, 158, 167, 168, 170-172, 185, 213, and 214, of SEQ ID NO:1.

The parent Ig heavy chain polypeptide may be modified to insert the tag in the amino acid sequence of the constant region in the $C_H2$ domain such that an antibody that includes the tag in its Ig heavy chain polypeptide, when the tag is converted, achieves a conjugation efficiency expressed as the payload to antibody ratio (e.g., drug to antibody ratio) of about 1.6 or greater. In some embodiments, the antibody achieves an antibody titer of about 100 mg/L or greater; and/or when the tag is converted and conjugated to a payload via fGly of the converted tag, a proportion of antibody monomers in solution of about 30% or greater. Insertion sites of interest in an Ig heavy chain polypeptide (e.g., IgG1, IgG2, IgG3 or IgG4 constant region polypeptide) include the position immediately N-terminal to an amino acid residue corresponding to one or more (e.g., two or more, including three or more) of positions 115, 116, 138-140, 151-153, 155, 158, 167, 168, 170-172, 185, 213, and 214, of SEQ ID NO:1.

In certain embodiments, an antibody of the present disclosure includes an Ig heavy chain polypeptide containing an amino acid sequence at least 90%, e.g., at least 95%, at least 97%, at least 99%, including 100% identical to any one of the sequences set forth in SEQ ID NOs:84, 85, 90-92, 94-96, 98-101, 103-105, 109, 115 and 116 shown in Table 9 in FIG. 17, where the amino acid sequence includes the tag, i.e., the FGE substrate motif: LCTPSR (SEQ ID NO:561) in the constant region $C_H2$ domain. In certain embodiments, the present antibody having the tagged Ig heavy chain polypeptide may exhibit an antibody titer of about 100 mg/L or greater, e.g., about 200 mg/L or greater, about 300 mg/L or greater, about 400 mg/L or greater, or about 500 mg/L or greater. The present antibody having the tagged Ig heavy chain polypeptide may exhibit, when the tag is converted, a conjugation efficiency (e.g., DAR) of about 1.6 or greater, or about 1.7 or greater. In some embodiments, the present antibody having the tagged Ig heavy chain polypeptide may exhibit, when the tag is converted and conjugated to a payload via fGly of the converted tag, a proportion of antibody monomers in solution of about 30% or greater, e.g., about 50% or greater, about 60% or greater, about 70% or greater, about 80% or greater, about 90% or greater, including about 95% or greater.

In certain embodiments, an antibody of the present disclosure, when the tag is converted, provides for a conjugation efficiency (e.g., DAR) of about 1.7 or greater. In some embodiments, the antibody provides for an antibody titer of about 100 mg/L or greater. An antibody conjugate that includes a payload conjugated to the present antibody via an fGly of a converted tag in the $C_H2$ domain of the Ig heavy chain polypeptide constant region may exhibit in solution a proportion of antibody monomers of about 30% or greater. In some embodiments, the antibody includes a tagged Ig heavy chain polypeptide, where the tag contains an amino acid sequence of the formula $X^1Z^1X^2Z^2X^3Z^3$, where $X^1$, $X^2$, $X^3$, $Z^1$, $Z^2$ and $Z^3$ are as described above (in ", and where the Ig heavy chain polypeptide includes a constant region containing any one or more (e.g., two or more, including three or more) of the amino acid sequences set forth in SEQ ID NOs:268, 269, 274-276, 278, 279, 282-284, 288-290, 294, and 301-304 of Table 3. In some embodiments, $Z^3$ is arginine. In some embodiments, $X^1$ is glycine, leucine, isoleucine, methionine, histidine, tyrosine, valine, serine, cysteine or threonine. In some embodiments, $X^2$ and $X^3$ are each independently serine, threonine, alanine, valine, glycine or cysteine. In some embodiments, the tag includes the amino acid sequence LCTPSR (SEQ ID NO:561).

The tag may be positioned between two consecutive amino acids in the $C_H2$ domain of the constant region of a corresponding parent Ig heavy chain polypeptide, e.g., the Ig heavy chain polypeptide without the tag in the constant region. Thus, the position of the tag in the Ig heavy chain amino acid sequence may be defined by the position of the most N-terminal amino acid of the amino acid sequence flanking the tag at its C-terminal end. In some embodiments, the tag is positioned adjacent and N-terminal to an amino acid residue of the Ig heavy chain polypeptide constant region (e.g., IgG1, IgG2, IgG3 or IgG4 constant region) corresponding to one or more (e.g., two or more, including three or more) of residues 116, 138-140, 151, 152, 155, 158, 170-172, 185, 213, and 214, of SEQ ID NO:1.

The parent Ig heavy chain polypeptide may be modified to insert the tag in the amino acid sequence of the constant region in the $C_H2$ domain such that an antibody that includes the tag in its Ig heavy chain polypeptide, when the tag is converted, achieves a conjugation efficiency expressed as the payload to antibody ratio (e.g., drug to antibody ratio) of about 1.7 or greater. In some embodiments, the antibody achieves an antibody titer of about 100 mg/L or greater; and/or when the tag is converted and conjugated to a payload via fGly of the converted tag, a proportion of antibody monomers in solution of about 30% or greater. Insertion sites of interest in an Ig heavy chain polypeptide (e.g., IgG1, IgG2, IgG3 or IgG4 constant region polypeptide) include the position immediately N-terminal to an amino acid residue corresponding to one or more (e.g., two or more, including three or more) of positions 116, 138-140, 151, 152, 155, 158, 170-172, 185, 213, and 214, of SEQ ID NO:1.

In certain embodiments, an antibody of the present disclosure includes an Ig heavy chain polypeptide containing an amino acid sequence at least 90%, e.g., at least 95%, at least 97%, at least 99%, including 100% identical to any one of the sequences set forth in SEQ ID NOs:85, 90-92, 94, 95, 98, 99, 103-105, 109, 115 and 116 shown in Table 9 in FIG. 17, where the amino acid sequence includes the tag, i.e., the FGE substrate motif: LCTPSR (SEQ ID NO:561) in the constant region $C_H2$ domain. In certain embodiments, the present antibody having the tagged Ig heavy chain polypeptide may exhibit an antibody titer of about 100 mg/L or greater, e.g., about 200 mg/L or greater, about 300 mg/L or greater, about 400 mg/L or greater, or about 500 mg/L or greater. The present antibody having the tagged Ig heavy chain polypeptide may exhibit, when the tag is converted, a conjugation efficiency (e.g., DAR) of about 1.7 or greater. In some embodiments, the present antibody having the tagged Ig heavy chain polypeptide may exhibit, when the tag is converted and conjugated to a payload via fGly of the converted tag, a proportion of antibody monomers in solution of about 30% or greater, e.g., about 50% or greater, about 60% or greater, about 70% or greater, about 80% or greater, about 90% or greater, including about 95% or greater.

In certain embodiments, an antibody of the present disclosure, when the tag is converted, provides for a conjugation efficiency (e.g., DAR) of about 1.7 or greater. In some embodiments, the antibody provides for an antibody titer of about 400 mg/L or greater. An antibody conjugate that includes a payload conjugated to the present antibody via an fGly of a converted tag in the $C_H2$ domain of the Ig heavy chain polypeptide constant region may exhibit in solution a proportion of antibody monomers of about 80% or greater. In some embodiments, the antibody includes a tagged Ig heavy chain polypeptide, where the tag contains an amino acid sequence of the formula $X^1Z^1X^2Z^2X^3Z^3$, where $X^1$, $X^2$, $X^3$, $Z^1$, $Z^2$ and $Z^3$ are as described above (in ", and where the Ig heavy chain polypeptide includes a constant region containing any one or more (e.g., two or more, including three or more) of the amino acid sequences set forth in SEQ ID NOs:268, 269, 278, 279, 282, 290 and 294 of Table 3. In some embodiments, $Z^3$ is arginine. In some embodiments, $X^1$ is glycine, leucine, isoleucine, methionine, histidine, tyrosine, valine, serine, cysteine or threonine. In some embodiments, $X^2$ and $X^3$ are each independently serine, threonine, alanine, valine, glycine or cysteine. In some embodiments, the tag includes the amino acid sequence LCTPSR (SEQ ID NO:561).

The tag may be positioned between two consecutive amino acids in the $C_H2$ domain of the constant region of a corresponding parent Ig heavy chain polypeptide, e.g., the Ig heavy chain polypeptide without the tag in the constant region. Thus, the position of the tag in the Ig heavy chain amino acid sequence may be defined by the position of the most N-terminal amino acid of the amino acid sequence flanking the tag at its C-terminal end. In some embodiments, the tag is positioned adjacent and N-terminal to an amino acid residue of the Ig heavy chain polypeptide constant region (e.g., IgG1, IgG2, IgG3 or IgG4 constant region) corresponding to one or more (e.g., two or more, including three or more) of residues 116, 151, 152, 155, 172, and 185, of SEQ ID NO:1.

The parent Ig heavy chain polypeptide may be modified to insert the tag in the amino acid sequence of the constant region in the $C_H2$ domain such that an antibody that includes the tag in its Ig heavy chain polypeptide, when the tag is converted, achieves a conjugation efficiency expressed as the payload to antibody ratio (e.g., drug to antibody ratio) of about 1.7 or greater. In some embodiments, the antibody achieves an antibody titer of about 400 mg/L or greater; and/or when the tag is converted and conjugated to a payload via fGly of the converted tag, a proportion of antibody monomers in solution of about 80% or greater. Insertion sites of interest in an Ig heavy chain polypeptide (e.g., IgG1, IgG2, IgG3 or IgG4 constant region polypeptide) include the position immediately N-terminal to an amino acid residue corresponding to one or more (e.g., two or more, including three or more) of positions 116, 151, 152, 155, 172, and 185, of SEQ ID NO:1.

In certain embodiments, an antibody of the present disclosure includes an Ig heavy chain polypeptide containing an amino acid sequence at least 90%, e.g., at least 95%, at least 97%, at least 99%, including 100% identical to any one of the sequences set forth in SEQ ID NOs:85, 94, 95, 98, 105, and 109 shown in Table 9 in FIG. 17, where the amino acid sequence includes the tag, i.e., the FGE substrate motif: LCTPSR (SEQ ID NO:561) in the constant region $C_H2$ domain. In certain embodiments, the present antibody having the tagged Ig heavy chain polypeptide may exhibit an antibody titer of about 400 mg/L or greater, or about 500 mg/L or greater. The present antibody having the tagged Ig heavy chain polypeptide may exhibit, when the tag is converted, a conjugation efficiency (e.g., DAR) of about 1.7 or greater. In some embodiments, the present antibody having the tagged Ig heavy chain polypeptide may exhibit, when the tag is converted and conjugated to a payload via fGly of the converted tag, a proportion of antibody monomers in solution of about 80% or greater, e.g., about 90% or greater, including about 95% or greater.

Antibodies Having a Tag in a CH3 Domain of an Ig Heavy Chain Constant Region

In some embodiments, an antibody of the present disclosure includes a tag in the $C_H3$ domain of an Ig heavy chain polypeptide constant region. Thus, the antibody may include a tag having an amino acid sequence of the formula $X^1Z^1X^2Z^2X^3Z^3$, where $X^1$, $X^2$, $X^3$, $Z^1$, $Z^2$ and $Z^3$ are as described above (in ", and where the Ig heavy chain polypeptide includes a constant region containing, in the $C_H3$ domain, any one or more (e.g., two or more, or three or more) of the amino acid sequences set forth in SEQ ID NOs:308-369, shown in Table 4. In some embodiments, the antibody provides for an antibody titer of about 100 mg/L or greater. In some cases, the antibody, when the tag is converted, as described herein, may provide for a conjugation efficiency, represented by the average molar ratio of payload to antibody (PAR, e.g., drug-to-antibody ratio (DAR)), of about 0.5 or greater. An antibody conjugate that includes a payload conjugated to the present antibody via an fGly of a converted tag in the $C_H3$ domain of the Ig heavy chain polypeptide constant region, as described below, may exhibit in solution a proportion of antibody monomers of about 20% or greater. In some embodiments, $Z^3$ is arginine. In some embodiments, $X^1$ is glycine, leucine, isoleucine, methionine, histidine, tyrosine, valine, serine, cysteine or threonine. In some embodiments, $X^2$ and $X^3$ are each independently serine, threonine, alanine, valine, glycine or cysteine. In some embodiments, the tag includes the amino acid sequence LCTPSR (SEQ ID NO:561).

TABLE 4

| Position | Sequence | SEQ ID NO: |
|---|---|---|
| 224G | [-KA/SKT]KX$^1$Z$^1$X$^2$Z$^2$X$^3$Z$^3$GQPR | 308 |
| 225Q | [A/T]KGX$^1$Z$^1$X$^2$Z$^2$X$^3$Z$^3$QPR | 309 |
| 227R | QPX$^1$Z$^1$X$^2$Z$^2$X$^3$Z$^3$REP | 310 |
| 228E | QPRX$^1$Z$^1$X$^2$Z$^2$X$^3$Z$^3$EP | 311 |
| 230Q | REPX$^1$Z$^1$X$^2$Z$^2$X$^3$Z$^3$QVY | 312 |
| 235P | YTLX$^1$Z$^1$X$^2$Z$^2$X$^3$Z$^3$PPS | 313 |
| 236P | TLPX$^1$Z$^1$X$^2$Z$^2$X$^3$Z$^3$PS[R/Q] | 314 |
| 237S | LPPX$^1$Z$^1$X$^2$Z$^2$X$^3$Z$^3$S[RE/RD/Q-] | 315 |
| 238R | PPSX$^1$Z$^1$X$^2$Z$^2$X$^3$Z$^3$[RE-/RD-/QEE] | 316 |
| 239E | PSRX$^1$Z$^1$X$^2$Z$^2$X$^3$Z$^3$[EE/DE] | 317 |
| 239E | PSQX$^1$Z$^1$X$^2$Z$^2$X$^3$Z$^3$EE | 318 |
| 240E | [-SR/PSQ]EX$^1$Z$^1$X$^2$Z$^2$X$^3$Z$^3$EM | 319 |
| 240E | RDX$^1$Z$^1$X$^2$Z$^2$X$^3$Z$^3$EL | 320 |
| 241M | [SR/-Q]EEX$^1$Z$^1$X$^2$Z$^2$X$^3$Z$^3$MT | 321 |
| 241L | DEX$^1$Z$^1$X$^2$Z$^2$X$^3$Z$^3$LTK | 322 |

TABLE 4-continued

| Position | Sequence | SEQ ID NO: |
|---|---|---|
| 243K | [-M/EL]TX$^1$X$^2$Z$^2$X$^3$Z$^3$KN | 323 |
| 244N | [M/L]TKX$^1$Z$^1$X$^2$Z$^2$X$^3$Z$^3$NQ | 324 |
| 246V | NQX$^1$Z$^1$X$^2$Z$^2$X$^3$Z$^3$VS | 325 |
| 247S | NQVX$^1$Z$^1$X$^2$Z$^2$X$^3$Z$^3$SLT | 326 |
| 254G | TCLVKX$^1$Z$^1$X$^2$Z$^2$X$^3$Z$^3$GF | 327 |
| 257P | FYX$^1$Z$^1$X$^2$Z$^2$X$^3$Z$^3$PS | 328 |
| 264W | [A/S]VEX$^1$Z$^1$X$^2$Z$^2$X$^3$Z$^3$WE | 329 |
| 267N | WESX$^1$Z$^1$X$^2$Z$^2$X$^3$Z$^3$[N/S]G | 330 |
| 268G | ES[N/S]X$^1$Z$^1$X$^2$Z$^2$X$^3$Z$^3$GQ | 331 |
| 269Q | [-SN/ESS]GX$^1$Z$^1$X$^2$Z$^2$X$^3$Z$^3$QP | 332 |
| 270P | [N/S]GQX$^1$Z$^1$X$^2$Z$^2$X$^3$Z$^3$PE | 333 |
| 271E | [N/S]GQPX$^1$Z$^1$X$^2$Z$^2$X$^3$Z$^3$EN | 334 |
| 272N | QPEX$^1$Z$^1$X$^2$Z$^2$X$^3$Z$^3$NN | 335 |
| 273N | ENX$^1$Z$^1$X$^2$Z$^2$X$^3$Z$^3$NY | 336 |
| 274Y | NNX$^1$Z$^1$X$^2$Z$^2$X$^3$Z$^3$Y[K/N] | 337 |
| 275K | NYX$^1$Z$^1$X$^2$Z$^2$X$^3$Z$^3$[K/N]T | 338 |
| 276T | NY[K/N]X$^1$Z$^1$X$^2$Z$^2$X$^3$Z$^3$TT | 339 |
| 277T | Y[K/N]TX$^1$Z$^1$X$^2$Z$^2$X$^3$Z$^3$TP | 340 |
| 279P | TTPX$^1$Z$^1$X$^2$Z$^2$X$^3$Z$^3$P[V/M] | 341 |
| 283S | LDX$^1$Z$^1$X$^2$Z$^2$X$^3$Z$^3$SD | 342 |
| 284D | DSX$^1$Z$^1$X$^2$Z$^2$X$^3$Z$^3$DG | 343 |
| 285G | DSDX$^1$Z$^1$X$^2$Z$^2$X$^3$Z$^3$GS | 344 |
| 286S | SDGX$^1$Z$^1$X$^2$Z$^2$X$^3$Z$^3$SF | 345 |
| 287F | GSX$^1$Z$^1$X$^2$Z$^2$X$^3$Z$^3$FF | 346 |
| 288F | SFX$^1$Z$^1$X$^2$Z$^2$X$^3$Z$^3$FL | 347 |
| 295V | [K/R]LTX$^1$Z$^1$X$^2$Z$^2$X$^3$Z$^3$VD | 348 |
| 296D | [K/R]LTVX$^1$Z$^1$X$^2$Z$^2$X$^3$Z$^3$DK | 349 |
| 297K | TVDX$^1$Z$^1$X$^2$Z$^2$X$^3$Z$^3$KSR | 350 |
| 298S | TVDKX$^1$Z$^1$X$^2$Z$^2$X$^3$Z$^3$SR | 351 |
| 299R | DKSX$^1$Z$^1$X$^2$Z$^2$X$^3$Z$^3$RW | 352 |
| 300W | KSRX$^1$Z$^1$X$^2$Z$^2$X$^3$Z$^3$WQ | 353 |
| 301Q | RWX$^1$Z$^1$X$^2$Z$^2$X$^3$Z$^3$QQ | 354 |
| 302Q | WQX$^1$Z$^1$X$^2$Z$^2$X$^3$Z$^3$QG | 355 |
| 303G | [-QQ/WQE]X$^1$Z$^1$X$^2$Z$^2$X$^3$Z$^3$GN | 356 |
| 304N | [Q/E]GX$^1$Z$^1$X$^2$Z$^2$X$^3$Z$^3$NV | 357 |
| 306F | [GNV/-NI]X$^1$Z$^1$X$^2$Z$^2$X$^3$Z$^3$FS | 358 |
| 307S | [NV/-I]FX$^1$Z$^1$X$^2$Z$^2$X$^3$Z$^3$SCS | 359 |
| 308C | FSX$^1$Z$^1$X$^2$Z$^2$X$^3$Z$^3$CS | 360 |
| 320T | [HY/RF]X$^1$Z$^1$X$^2$Z$^2$X$^3$Z$^3$TQ | 361 |

TABLE 4-continued

| Position | Sequence | SEQ ID NO: |
|---|---|---|
| 321Q | [HY/-F]TX$^1$Z$^1$X$^2$Z$^2$X$^3$Z$^3$QK | 362 |
| 322K | [Y/F]TQX$^1$Z$^1$X$^2$Z$^2$X$^3$Z$^3$KS | 363 |
| 323S | QKX$^1$Z$^1$X$^2$Z$^2$X$^3$Z$^3$SLSLS | 364 |
| 324L | QKSX$^1$Z$^1$X$^2$Z$^2$X$^3$Z$^3$LSLS | 365 |
| 325S | KSLX$^1$Z$^1$X$^2$Z$^2$X$^3$Z$^3$SLS | 366 |
| 327S | KSLSLX$^1$Z$^1$X$^2$Z$^2$X$^3$Z$^3$S | 367 |
| 328P | LSLSX$^1$Z$^1$X$^2$Z$^2$X$^3$Z$^3$[P/L] | 368 |
| 329G | [---SP/LSLSL]X$^1$Z$^1$X$^2$Z$^2$X$^3$Z$^3$G | 369 |

([*/*] denotes alternative amino acids (or amino acid sequences) chosen from the amino acid residues (or sequences) separated by "/". "-" denotes that no amino acid is required there to specify the position.)

As described above, the tag may be positioned between two consecutive amino acids in the $C_H3$ domain of the constant region of a corresponding parent Ig heavy chain polypeptide, e.g., the Ig heavy chain polypeptide without the tag in the constant region. In some cases, the tag is positioned at the N-terminal end of the $C_H3$ domain (i.e., between the $C_H2$ domain and the $C_H3$ domain of the Ig heavy chain constant region). Thus, the position of the tag in the Ig heavy chain amino acid sequence may be defined by the position of the most N-terminal amino acid of the amino acid sequence flanking the tag at its C-terminal end. In some embodiments, the tag is positioned adjacent and N-terminal to an amino acid residue of the Ig heavy chain polypeptide constant region (e.g., IgG1, IgG2, IgG3 or IgG4 constant region) corresponding to one or more (e.g., two or more, including three or more) of residues 224, 225, 227, 228, 230, 235-241, 243, 244, 246, 247, 254, 257, 264, 267-277, 279, 283-288, 295-304, 306-308, 320-325 and 327-329, of SEQ ID NO:1.

The parent Ig heavy chain polypeptide may be modified to insert the tag in the amino acid sequence of the constant region in the $C_H3$ domain such that an antibody that includes the tag in its Ig heavy chain polypeptide, when the tag is converted, achieves a conjugation efficiency expressed as the payload to antibody ratio (e.g., drug to antibody ratio) of about 0.5 or greater. In some embodiments, the antibody achieves an antibody titer of about 100 mg/L or greater; and/or when the tag is converted and conjugated to a payload via fGly of the converted tag, a proportion of antibody monomers in solution of about 20% or greater. Insertion sites of interest in an Ig heavy chain polypeptide (e.g., IgG1, IgG2, IgG3 or IgG4 constant region polypeptide) include the position immediately N-terminal to an amino acid residue corresponding to one or more (e.g., two or more, including three or more) of positions 224, 225, 227, 228, 230, 235-241, 243, 244, 246, 247, 254, 257, 264, 267-277, 279, 283-288, 295-304, 306-308, 320-325 and 327-329, of SEQ ID NO:1.

In certain embodiments, an antibody of the present disclosure includes an Ig heavy chain polypeptide containing an amino acid sequence at least 90%, e.g., at least 95%, at least 97%, at least 99%, including 100% identical to any one of the sequences set forth in SEQ ID NOs:120-178, shown in Table 10 in FIG. 18, where the amino acid sequence includes the tag, i.e., the FGE substrate motif: LCTPSR (SEQ ID NO:561) in the constant region $C_H3$ domain. In certain embodiments, the present antibody having the tagged Ig heavy chain polypeptide may exhibit an antibody titer of about 100 mg/L or greater, e.g., about 200 mg/L or greater, about 400 mg/L or greater, about 600 mg/L or greater, about 800 mg/L or greater, including about 1,000 mg/L or greater. In some embodiments, the present antibody having the tagged Ig heavy chain polypeptide may exhibit, when the tag is converted, a conjugation efficiency (e.g., DAR) of about 0.5 or greater, e.g., about 1.0 or greater, about 1.6 or greater, or about 1.7 or greater. In some embodiments, the present antibody having the tagged Ig heavy chain polypeptide may exhibit, when the tag is converted and conjugated to a payload via fGly of the converted tag, a proportion of antibody monomers in solution of about 20% or greater, e.g., about 40% or greater, about 60% or greater, about 70% or greater, about 80% or greater, about 90% or greater, including about 95% or greater.

In certain embodiments, an antibody of the present disclosure, when the tag is converted, provides for a conjugation efficiency (e.g., DAR) of about 1.0 or greater. In some embodiments, the antibody provides for an antibody titer of about 100 mg/L or greater. An antibody conjugate that includes a payload conjugated to the present antibody via an fGly of a converted tag in the $C_H3$ domain of the Ig heavy chain polypeptide constant region may exhibit in solution a proportion of antibody monomers of about 20% or greater. In some embodiments, the antibody includes a tagged Ig heavy chain polypeptide, where the tag contains an amino acid sequence of the formula X$^1$Z$^1$X$^2$Z$^2$X$^3$Z$^3$, where X$^1$, X$^2$, X$^3$, Z$^1$, Z$^2$ and Z$^3$ are as described above (in ", and where the Ig heavy chain polypeptide includes a constant region containing any one or more (e.g., two or more, including three or more) of the amino acid sequences set forth in SEQ ID NOs:309-312, 314-318, 325-328, 331-340, 343-349, 351-361, 363, 364, and 366-369, of Table 4. In some embodiments, Z$^3$ is arginine. In some embodiments, X$^1$ is glycine, leucine, isoleucine, methionine, histidine, tyrosine, valine, serine, cysteine or threonine. In some embodiments, X$^2$ and X$^3$ are each independently serine, threonine, alanine, valine, glycine or cysteine. In some embodiments, the tag includes the amino acid sequence LCTPSR (SEQ ID NO:561).

The tag may be positioned between two consecutive amino acids in the $C_H3$ domain of the constant region of a corresponding parent Ig heavy chain polypeptide, e.g., the Ig heavy chain polypeptide without the tag in the constant region. Thus, the position of the tag in the Ig heavy chain amino acid sequence may be defined by the position of the most N-terminal amino acid of the amino acid sequence flanking the tag at its C-terminal end. In some embodiments, the tag is positioned adjacent and N-terminal to an amino acid residue of the Ig heavy chain polypeptide constant region (e.g., IgG1, IgG2, IgG3 or IgG4 constant region) corresponding to one or more (e.g., two or more, including three or more) of residues 225, 227, 228, 230, 236-239, 246, 247, 254, 257, 268-277, 284-288, 295, 296, 298-304, 306-308, 320, 322, 323, 325, and 327-329, of SEQ ID NO:1.

In some cases, the parent Ig heavy chain polypeptide may be modified to insert the tag in the amino acid sequence of the constant region in the $C_H3$ domain such that an antibody that includes the tag in its Ig heavy chain polypeptide, when the tag is converted, achieves a conjugation efficiency expressed as the payload to antibody ratio (e.g., drug to antibody ratio) of about 1.0 or greater. In some embodiments, the antibody achieves an antibody titer of about 100 mg/L or greater; and/or when the tag is converted and conjugated to a payload via fGly of the converted tag, a proportion of antibody monomers in solution of about 20% or greater. Insertion sites of interest in an Ig heavy chain polypeptide (e.g., IgG1, IgG2, IgG3 or IgG4 constant region polypeptide) include the position immediately N-terminal to an amino acid residue corresponding to one or more (e.g., two or more, including three or more) of positions 225, 227, 228, 230, 236-239, 246, 247, 254, 257, 268-277, 284-288, 295, 296, 298-304, 306-308, 320, 322, 323, 325, and 327-329, of SEQ ID NO:1.

In certain embodiments, an antibody of the present disclosure includes an Ig heavy chain polypeptide containing an amino acid sequence at least 90%, e.g., at least 95%, at least 97%, at least 99%, including 100% identical to any one of the sequences set forth in SEQ ID NOs:121-124, 126-129, 133-137, 140-149, 152-158, 160-170, 172, 173, and 175-178, shown in Table 10 in FIG. 18, where the amino acid sequence includes the tag, i.e., the FGE substrate motif: LCTPSR (SEQ ID NO:561) in the constant region $C_H3$ domain. In certain embodiments, the present antibody having the tagged Ig heavy chain polypeptide may exhibit an antibody titer of about 100 mg/L or greater, e.g., about 400 mg/L or greater, about 600 mg/L or greater, about 800 mg/L or greater, including about 1,000 mg/L or greater. In some embodiments, the present antibody having the tagged Ig heavy chain polypeptide may exhibit, when the tag is converted, a conjugation efficiency (e.g., DAR) of about 1.0 or greater, or about 1.6 or greater. In some embodiments, the present antibody having the tagged Ig heavy chain polypeptide may exhibit, when the tag is converted and conjugated to a payload via fGly of the converted tag, a proportion of antibody monomers in solution of about 20% or greater, e.g., about 40% or greater, about 60% or greater, about 70% or greater, about 80% or greater, about 90% or greater, including about 95% or greater.

In certain embodiments, an antibody of the present disclosure, when the tag is converted, provides for a conjugation efficiency (e.g., DAR) of about 1.6 or greater. In some embodiments, the antibody provides for an antibody titer of about 100 mg/L or greater. An antibody conjugate that includes a payload conjugated to the present antibody via an fGly of a converted tag in the $C_H3$ domain of the Ig heavy chain polypeptide constant region may exhibit in solution a proportion of antibody monomers of about 40% or greater. In some embodiments, the antibody includes a tagged Ig heavy chain polypeptide, where the tag contains an amino acid sequence of the formula $X^1Z^1X^2Z^2X^3Z^3$, where $X^1$, $X^2$, $X^3$, $Z^1$, $Z^2$ and $Z^3$ are as described above (in ", and where the Ig heavy chain polypeptide includes a constant region containing any one or more (e.g., two or more, including three or more) of the amino acid sequences set forth in SEQ ID NOs:309, 310, 326, 331, 334, 336, 338, 339, 343, 347, 349, 351-353, 355, 357-361, 364, and 369 of Table 4. In some embodiments, $Z^3$ is arginine. In some embodiments, $X^1$ is glycine, leucine, isoleucine, methionine, histidine, tyrosine, valine, serine, cysteine or threonine. In some embodiments, $X^2$ and $X^3$ are each independently serine, threonine, alanine, valine, glycine or cysteine. In some embodiments, the tag includes the amino acid sequence LCTPSR (SEQ ID NO:561).

The tag may be positioned between two consecutive amino acids in the $C_H3$ domain of the constant region of a corresponding parent Ig heavy chain polypeptide, e.g., the Ig heavy chain polypeptide without the tag in the constant region. Thus, the position of the tag in the Ig heavy chain amino acid sequence may be defined by the position of the most N-terminal amino acid of the amino acid sequence flanking the tag at its C-terminal end. In some embodiments, the tag is positioned adjacent and N-terminal to an amino acid residue of the Ig heavy chain polypeptide constant region (e.g., IgG1, IgG2, IgG3 or IgG4 constant region) corresponding to one or more (e.g., two or more, including three or more) of residues 225, 227, 247, 268, 271, 273, 275, 276, 284, 288, 296, 298-300, 302, 304, 306-308, 320, 323, and 329, of SEQ ID NO:1.

In some cases, the parent Ig heavy chain polypeptide may be modified to insert the tag in the amino acid sequence of the constant region in the $C_H3$ domain such that an antibody that includes the tag in its Ig heavy chain polypeptide, when the tag is converted, achieves a conjugation efficiency expressed as the payload to antibody ratio (e.g., drug to antibody ratio) of about 1.6 or greater. In some embodiments, the antibody achieves an antibody titer of about 100 mg/L or greater; and/or when the tag is converted and conjugated to a payload via fGly of the converted tag, a proportion of antibody monomers in solution of about 40% or greater. Insertion sites of interest in an Ig heavy chain polypeptide (e.g., IgG1, IgG2, IgG3 or IgG4 constant region polypeptide) include the position immediately N-terminal to an amino acid residue corresponding to one or more (e.g., two or more, including three or more) of positions 225, 227, 247, 268, 271, 273, 275, 276, 284, 288, 296, 298-300, 302, 304, 306-308, 320, 323, and 329, of SEQ ID NO:1.

In certain embodiments, an antibody of the present disclosure includes an Ig heavy chain polypeptide containing an amino acid sequence at least 90%, e.g., at least 95%, at least 97%, at least 99%, including 100% identical to any one of the sequences set forth in SEQ ID NOs:121, 122, 135, 140, 143, 145, 147, 148, 152, 156, 158, 160-162, 164, 166-170, 173, and 178, shown in Table 10 in FIG. 18, where the amino acid sequence includes the tag, i.e., the FGE substrate motif: LCTPSR (SEQ ID NO:561) in the constant region $C_H3$ domain. In certain embodiments, the present antibody having the tagged Ig heavy chain polypeptide may exhibit an antibody titer of about 100 mg/L or greater, e.g., about 200 mg/L or greater, about 400 mg/L or greater, about 600 mg/L or greater, about 800 mg/L or greater, including about 1,000 mg/L or greater. The present antibody having the tagged Ig heavy chain polypeptide may exhibit, when the tag is converted, a conjugation efficiency (e.g., DAR) of about 1.6 or greater, or about 1.7 or greater. In some embodiments, the present antibody having the tagged Ig heavy chain polypeptide may exhibit, when the tag is converted and conjugated to a payload via fGly of the converted tag, a proportion of antibody monomers in solution of about 40% or greater, e.g., about 60% or greater, about 70% or greater, about 80% or greater, about 90% or greater, including about 95% or greater.

In certain embodiments, an antibody of the present disclosure, when the tag is converted, provides for a conjugation efficiency (e.g., DAR) of about 1.7 or greater. In some embodiments, the antibody provides for an antibody titer of about 100 mg/L or greater. An antibody conjugate that includes a payload conjugated to the present antibody via an fGly of a converted tag in the $C_H3$ domain of the Ig heavy chain polypeptide constant region may exhibit in solution a proportion of antibody monomers of about 40% or greater. In some embodiments, the antibody includes a tagged Ig heavy chain polypeptide, where the tag contains an amino acid sequence of the formula $X^1Z^1X^2Z^2X^3Z^3$, where $X^1$, $X^2$, $X^3$, $Z^1$, $Z^2$ and $Z^3$ are as described above (in ", and where the Ig heavy chain polypeptide includes a constant region containing any one or more (e.g., two or more, including three or more) of the amino acid sequences set forth in SEQ ID NOs:310, 326, 331, 334, 339, 347, 349, 352, 353, 357-360, 364 and 369 of Table 4. In some embodiments, $Z^3$ is arginine. In some embodiments, $X^1$ is glycine, leucine, isoleucine, methionine, histidine, tyrosine, valine, serine, cysteine or threonine. In some embodiments, $X^2$ and $X^3$ are each independently serine, threonine, alanine, valine, glycine or cysteine. In some embodiments, the tag includes the amino acid sequence LCTPSR (SEQ ID NO:561).

The tag may be positioned between two consecutive amino acids in the $C_H3$ domain of the constant region of a corresponding parent Ig heavy chain polypeptide, e.g., the Ig heavy chain polypeptide without the tag in the constant region. Thus, the position of the tag in the Ig heavy chain amino acid sequence may be defined by the position of the most N-terminal amino acid of the amino acid sequence flanking the tag at its C-terminal end. In some embodiments, the tag is positioned adjacent and N-terminal to an amino acid residue of the Ig heavy chain polypeptide constant region (e.g., IgG1, IgG2, IgG3 or IgG4 constant region) corresponding to one or more (e.g., two or more, including three or more) of residues 227, 247, 268, 271, 276, 288, 296, 299, 300, 304, 306-308, 323, and 329, of SEQ ID NO:1.

In some cases, the parent Ig heavy chain polypeptide may be modified to insert the tag in the amino acid sequence of the constant region in the $C_H3$ domain such that an antibody that includes the tag in its Ig heavy chain polypeptide, when the tag is converted, achieves a conjugation efficiency expressed as the payload to antibody ratio (e.g., drug to antibody ratio) of about 1.7 or greater. In some embodiments, the antibody achieves an antibody titer of about 100 mg/L or greater; and/or when the tag is converted and conjugated to a payload via fGly of the converted tag, a proportion of antibody monomers in solution of about 40% or greater. Insertion sites of interest in an Ig heavy chain polypeptide (e.g., IgG1, IgG2, IgG3 or IgG4 constant region polypeptide) include the position immediately N-terminal to an amino acid residue corresponding to one or more (e.g., two or more, including three or more) of positions 227, 247, 268, 271, 276, 288, 296, 299, 300, 304, 306-308, 323, and 329, of SEQ ID NO:1.

In certain embodiments, an antibody of the present disclosure includes an Ig heavy chain polypeptide containing an amino acid sequence at least 90%, e.g., at least 95%, at least 97%, at least 99%, including 100% identical to any one of the sequences set forth in SEQ ID NOs:122, 135, 140, 143, 148, 156, 158, 161, 162, 166-169, 173, and 178, shown in Table 10 in FIG. 18, where the amino acid sequence includes the tag, i.e., the FGE substrate motif: LCTPSR (SEQ ID NO:561) in the constant region $C_H3$ domain. In certain embodiments, the present antibody having the tagged Ig heavy chain polypeptide may exhibit an antibody titer of about 100 mg/L or greater, e.g., about 200 mg/L or greater, about 400 mg/L or greater, about 600 mg/L or greater, about 800 mg/L or greater, including about 1,000 mg/L or greater. The present antibody having the tagged Ig heavy chain polypeptide may exhibit, when the tag is converted, a conjugation efficiency (e.g., DAR) of about 1.6 or greater, or about 1.7 or greater. In some embodiments, the present antibody having the tagged Ig heavy chain polypeptide may exhibit, when the tag is converted and conjugated to a payload via fGly of the converted tag, a proportion of antibody monomers in solution of about 40% or greater, e.g., about 60% or greater, about 70% or greater, about 80% or greater, about 90% or greater, including about 95% or greater.

In certain embodiments, an antibody of the present disclosure, when the tag is converted, provides for a conjugation efficiency (e.g., DAR) of about 1.7 or greater. In some embodiments, the antibody provides for an antibody titer of about 600 mg/L or greater. An antibody conjugate that includes a payload conjugated to the present antibody via an fGly of a converted tag in the $C_H3$ domain of the Ig heavy chain polypeptide constant region may exhibit in solution a proportion of antibody monomers of about 80% or greater.

In some embodiments, the antibody includes a tagged Ig heavy chain polypeptide, where the tag contains an amino acid sequence of the formula $X^1Z^1X^2Z^2X^3Z^3$, where $X^1$, $X^2$, $X^3$, $Z^1$, $Z^2$ and $Z^3$ are as described above (in ", and where the Ig heavy chain polypeptide includes a constant region containing any one or more (e.g., two or more, including three or more) of the amino acid sequences set forth in SEQ ID NOs:310, 326, 331, 334, 339, 353, 357, and 358, of Table 4. In some embodiments, $Z^3$ is arginine. In some embodiments, $X^1$ is glycine, leucine, isoleucine, methionine, histidine, tyrosine, valine, serine, cysteine or threonine. In some embodiments, $X^2$ and $X^3$ are each independently serine, threonine, alanine, valine, glycine or cysteine. In some embodiments, the tag includes the amino acid sequence LCTPSR (SEQ ID NO:561).

The tag may be positioned between two consecutive amino acids in the $C_H3$ domain of the constant region of a corresponding parent Ig heavy chain polypeptide, e.g., the Ig heavy chain polypeptide without the tag in the constant region. Thus, the position of the tag in the Ig heavy chain amino acid sequence may be defined by the position of the most N-terminal amino acid of the amino acid sequence flanking the tag at its C-terminal end. In some embodiments, the tag is positioned adjacent and N-terminal to an amino acid residue of the Ig heavy chain polypeptide constant region (e.g., IgG1, IgG2, IgG3 or IgG4 constant region) corresponding to one or more (e.g., two or more, including three or more) of residues 227, 247, 268, 271, 276, 300, 304, and 306, of SEQ ID NO:1.

In some cases, the parent Ig heavy chain polypeptide may be modified to insert the tag in the amino acid sequence of the constant region in the $C_H3$ domain such that an antibody that includes the tag in its Ig heavy chain polypeptide, when the tag is converted, achieves a conjugation efficiency expressed as the payload to antibody ratio (e.g., drug to antibody ratio) of about 1.7 or greater. In some embodiments, the antibody achieves an antibody titer of about 600 mg/L or greater; and/or when the tag is converted and conjugated to a payload via fGly of the converted tag, a proportion of antibody monomers in solution of about 80% or greater. Insertion sites of interest in an Ig heavy chain polypeptide (e.g., IgG1, IgG2, IgG3 or IgG4 constant region polypeptide) include the position immediately N-terminal to an amino acid residue corresponding to one or more (e.g., two or more, including three or more) of positions 227, 247, 268, 271, 276, 300, 304, and 306, of SEQ ID NO:1.

In certain embodiments, an antibody of the present disclosure includes an Ig heavy chain polypeptide containing an amino acid sequence at least 90%, e.g., at least 95%, at least 97%, at least 99%, including 100% identical to any one of the sequences set forth in SEQ ID NOs:122, 135, 140, 143, 148, 162, 166, and 167, shown in Table 10 in FIG. 18, where the amino acid sequence includes the tag, i.e., the FGE substrate motif: LCTPSR (SEQ ID NO:561) in the constant region $C_H3$ domain. In certain embodiments, the present antibody having the tagged Ig heavy chain polypeptide may exhibit an antibody titer of about 600 mg/L or greater, e.g., about 800 mg/L or greater, including about 1,000 mg/L or greater. The present antibody having the tagged Ig heavy chain polypeptide may exhibit, when the tag is converted, a conjugation efficiency (e.g., DAR) of about 1.7 or greater. In some embodiments, the present antibody having the tagged Ig heavy chain polypeptide may exhibit, when the tag is converted and conjugated to a payload via fGly of the converted tag, a proportion of antibody monomers in solution of about 80% or greater, e.g., about 90% or greater, including about 95% or greater.

An antibody of the present disclosure generally includes a tagged Ig heavy chain polypeptide constant region, as described herein, and an Ig heavy chain variable region ($V_H$); and includes an Ig light chain having a constant region ($C_L$) and a variable region ($V_L$), where the antibody specifically binds an antigen. In other words, the tagged Ig heavy chain polypeptide forms an antigen-binding antibody when suitably combined with an Ig light chain polypeptide. The Ig light chain polypeptide can include an Ig kappa or lambda light chain, or any allotypic variant of same, e.g., human Ig light chain polypeptide or mouse Ig light chain polypeptide, a hybrid Ig light chain polypeptide, a synthetic Ig light chain polypeptide, or a consensus sequence Ig light chain polypeptide, etc.

In some embodiments, the present antibody includes an Ig light chain polypeptide that does not include a tag, e.g., does not include a tag in the light chain constant region. In some embodiments, the antibody includes an Ig light chain polypeptide having one or more, e.g., two or more, including three or more tags, i.e., a tag containing a sulfatase motif. Any suitable Ig light chain polypeptides with a tag in the constant region may be used. Suitable Ig light chain polypeptides with a tag (i.e., an FGE substrate motif) in the constant region are described in, e.g., US20120183566 and U.S. application No. 62/327,906, filed on Apr. 26, 2016, the disclosures of which are incorporated herein by reference in their entirety.

fGLY-Modified Antibodies

A tagged antibody, as described above, may be modified, e.g., by oxidation of the side chain of a cysteine or serine residue in the tag into an aldehyde side chain, such that the tag is converted to a converted tag containing a 2-formylglycine residue (fGly), as described above, to generate a fGly-modified antibody. Where the Ig heavy chain polypeptide includes a tag containing a formylglycine generating enzyme (FGE) substrate motif of formula I, as described above, $Z^1$ may be modified to fGly through the action of FGE, to generate a converted tag that includes an amino acid sequence of the formula $X^1(fGly)X^2Z^2X^3Z^3$, where $X^1$, $X^2$, $X^3$, $Z^2$, and $Z^3$ are as described above.

The enzyme that oxidizes cysteine or serine in a sulfatase motif to fGly is referred to herein as a formylglycine generating enzyme (FGE). As discussed above, "FGE" is used herein to refer to fGly-generating enzymes that mediate conversion of a cysteine (C) of a sulfatase motif to fGly as well as fGly-generating enzymes that mediate conversion of serine (S) of a sulfatase motif to fGly. It should be noted that in general, the literature refers to fGly-generating enzymes that convert a C to fGly in a sulfatase motif as FGEs, and refers to enzymes that convert S to fGly in a sulfatase motif as Ats-B-like. However, for purposes of the present disclosure "FGE" is used generically to refer to both types of fGly-generating enzymes, with the understanding that an appropriate FGE will be selected according to the target reactive partner containing the appropriate sulfatase motif (i.e., C-containing or S-containing).

In general, the FGE used to facilitate conversion of cysteine or serine to fGly in a sulfatase motif of a tag of a target polypeptide is selected according to the sulfatase motif present in the tag. The FGE can be native to the host cell in which the tag-containing polypeptide is expressed, or the host cell can be genetically modified to express an appropriate FGE. In some embodiments it may be desired to use a sulfatase motif compatible with a human FGE (e.g., the SUMF1-type FGE, see, e.g., Cosma et al. Cell 113, 445-56 (2003); Dierks et al. Cell 113, 435-44 (2003)), and express the aldehyde tagged protein in a human cell that expresses the FGE or in a host cell, usually a mammalian cell, genetically modified to express a human FGE.

In general, an FGE for use in the methods disclosed herein can be obtained from naturally occurring sources or synthetically produced. For example, an appropriate FGE can be derived from biological sources which naturally produce an FGE or which are genetically modified to express a recombinant gene encoding an FGE. Nucleic acids encoding a number of FGEs are known in the art and readily available (see, e.g., Preusser et al. 2005 J. Biol. Chem. 280(15):14900-10 (Epub 2005 Jan. 18); Fang et al. 2004 J Biol Chem. 79(15):14570-8 (Epub 2004 Jan. 28); Landgrebe et al. Gene. 2003 Oct. 16; 316:47-56; Dierks et al. 1998 FEBS Lett. 423(1):61-5; Dierks et al. Cell. 2003 May 16; 113(4):435-44; Cosma et al. (2003 May 16) Cell 113(4):445-56; Baenziger (2003 May 16) Cell 113(4):421-2 (review); Dierks et al. Cell. 2005 May 20; 121(4):541-52; Roeser et al. (2006 Jan. 3)Proc Natl Acad Sci USA 103(1):81-6; Sardiello et al. (2005 Nov. 1) Hum Mol Genet. 14(21):3203-17; WO 2004/072275; WO 2008/036350; U.S. Patent Publication No. 2008/0187956; and GenBank Accession No. NM 182760. Accordingly, the disclosure here provides for recombinant host cells genetically modified to express an FGE that is compatible for use with a tag of a target polypeptide. In certain embodiments, the FGE used may be a naturally occurring enzyme (may have a wild type amino acid sequence). In other embodiments, the FGE used may be non-naturally occurring, in which case it may, in certain cases, have an amino acid sequence that is at least 80% identical, at least 90% identical or at least 95% identical to that of a wild type enzyme. Because FGEs have been studied structurally and functionally and the amino acid sequences of several examples of such enzymes are available, variants that retain enzymatic activity should be readily designable.

Where a cell-free method is used to convert a sulfatase motif-containing polypeptide, an isolated FGE can be used. Any convenient protein purification procedures may be used to isolate an FGE, see, e.g., Guide to Protein Purification, (Deuthser ed.) (Academic Press, 1990). For example, a lysate may be prepared from a cell that produces a desired FGE, and purified using HPLC, exclusion chromatography, gel electrophoresis, affinity chromatography, and the like.

Any suitable method of generating a tagged antibody having a sulfatase motif in its Ig polypeptide, e.g., Ig heavy chain polypeptide, and converting the tag to include an fGly residue, may be used, e.g., as described in US20120183566, which is incorporated herein by reference.

Thus, the present disclosure includes an fGly-modified antibody that includes a converted tag in an fGly-modified Ig heavy chain polypeptide, e.g., fGly-modified Ig kappa heavy chain polypeptide, where the converted tag contains an amino acid sequence of the formula:

$$X^1(fGly)X^2Z^2X^3Z^3 \qquad (II)$$

where fGly is a formylglycine residue; $Z^2$ is either a proline or alanine residue (which can also be represented by (P/A)); $Z^3$ is a basic amino acid (e.g., arginine (R), and may be lysine (K) or histidine (H), usually lysine), or an aliphatic amino acid (alanine (A), glycine (G), leucine (L), valine (V), isoleucine (I), or proline (P), usually A, G, L, V, or I; $X^1$ is present or absent and, when present, can be any amino acid, though usually an aliphatic amino acid, a sulfur-containing amino acid, or a polar, uncharged amino acid, (i.e., other than a aromatic amino acid or a charged amino acid), usually L, M, V, S or T, more usually L, M, S or V; and $X^2$ and $X^3$ independently can be any amino acid, though usually an aliphatic amino acid, a polar, uncharged amino acid, or a sulfur containing amino acid (i.e., other than an aromatic amino acid or a charged amino acid), usually S, T, A, V, G or C, more usually S, T, A, V or G.

As the converted tag may be derived from an unconverted tag, e.g., through the oxidation of a cysteine or serine in the sulfatase motif of a tag via the action of FGE, the position of the converted tag may be defined by the position of the tag in the Ig heavy chain polypeptide, as described above. Thus in some embodiments, an fGly-modified antibody of the present disclosure includes an fGly-modified Ig heavy chain polypeptide that includes a converted tag having an amino acid sequence of the formula $X^1Z^1X^2Z^2X^3Z^3$, where $X^1$, $X^2$, $X^3$, $Z^2$ and $Z^3$ are as described above, and where $Z^1$ is fGly, and where the fGly-modified Ig heavy chain polypeptide includes a constant region containing any one or more (e.g., two or more, including three or more) of the amino acid sequences set forth in SEQ ID NOs:214-404, shown in Tables 1-4, where $Z^1$ is fGly and $X^1$, $X^2$, $X^3$, $Z^2$ and $Z^3$ are as described above. In some embodiments, the converted tag contained in the fGly-modified Ig heavy chain polypeptide has the amino acid sequence L(fGly)TPSR (SEQ ID NO:607). As described above, the antibody containing a converted tag in an Ig heavy chain polypeptide constant region may exhibit a conjugation efficiency, represented by the average molar ratio of payload to antibody (e.g., drug to antibody (DAR)), of about 0.5 or greater, e.g., 1.0 or greater, including 1.6 or greater.

In some cases, the present antibody containing a converted tag in an Ig heavy chain polypeptide constant region provides for a conjugation efficiency, represented by the average molar ratio of payload (e.g., drugs) to antibody, of 1.0 or greater. In such cases, the fGly-modified Ig heavy chain polypeptide includes a constant region containing any one or more (e.g., two or more, including three or more) of the amino acid sequences set forth in: SEQ ID NOs:181, 182-184, 186, 190-201, 205-214, 216-220, 222-241, 244-250 of Table 1; SEQ ID NOs:254-256 and 258-264 of Table 2; SEQ ID NOs:265-271, 274-280, 282-291, 293-295, and 298-307 of Table 3; and SEQ ID NOs:309-312, 314-318, 325-328, 331-340, 343-349, 351-361, 363, 364, and 366-369, of Table 4, where $Z^1$ is fGly and $X^1$, $X^2$, $X^3$, $Z^2$ and $Z^3$ are as described above. In some cases, the converted tag contained in the fGly-modified Ig heavy chain polypeptide has the amino acid sequence L(fGly)TPSR (SEQ ID NO:607).

In some cases, the present antibody containing a converted tag in an Ig heavy chain polypeptide constant region provides for a conjugation efficiency, represented by the average molar ratio of payload (e.g., drugs) to antibody, of about 1.6 or greater. In such cases, the fGly-modified Ig heavy chain polypeptide includes a constant region containing any one or more (e.g., two or more, including three or more) of the amino acid sequences set forth in: SEQ ID NOs:181, 182, 184, 186, 195-201, 206-212, 214, 216-220, 223-228, 231-241, and 244-250 of Table 1; SEQ ID NOs: 258-263 of Table 2; SEQ ID NOs:267-269, 274-276, 278-280, 282-286, 288-290, 294, and 301-304 of Table 3; and SEQ ID NOs:309, 310, 326, 331, 334, 336, 338, 339, 343, 347, 349, 351-353, 355, 357-361, 364, and 369 of Table 4, where $Z^1$ is fGly and $X^1$, $X^2$, $X^3$, $Z^2$ and $Z^3$ are as described above. In some cases, the converted tag contained in the fGly-modified Ig heavy chain polypeptide has the amino acid sequence L(fGly)TPSR (SEQ ID NO:607).

In some cases, the present antibody containing a converted tag in an Ig heavy chain polypeptide constant region provides for a conjugation efficiency, represented by the average molar ratio of payload (e.g., drugs) to antibody, of about 1.7 or greater. In such cases, the fGly-modified Ig heavy chain polypeptide includes a constant region containing any one or more (e.g., two or more, including three or more) of the amino acid sequences set forth in: SEQ ID NOs: 197-200, 206, 208-211, 216, 218-220, 223-228, 231-241, 246, 248, and 249 of Table 1; SEQ ID NOs: 258, 259, 261 or 263 of Table 2; SEQ ID NOs:268, 269, 274-276, 278, 279, 282-284, 288-290, 294, and 301-304 of Table 3; and SEQ ID NOs:310, 326, 331, 334, 339, 347, 349, 352, 353, 357-360, 364 and 369 of Table 4, where $Z^1$ is fGly and $X^1$, $X^2$, $X^3$, $Z^2$ and $Z^3$ are as described above. In some cases, the converted tag contained in the fGly-modified Ig heavy chain polypeptide has the amino acid sequence L(fGly)TPSR (SEQ ID NO:607).

Antibody Conjugates

An antibody containing an fGly-modified Ig heavy chain polypeptide, as described above, may be modified to covalently attach a moiety of interest (i.e., a payload, e.g., drug) to the antibody in a site-specific manner, to produce an antibody conjugate. As described above, the aldehyde moiety of the fGly residue in the converted tag of an Ig heavy chain polypeptide provides a bioorthogonal reactive side chain with which an aldehyde-reactive group attached to a payload, e.g., a drug functionalized with an aldehyde-reactive group, can react in a chemoselective manner to form a covalent bond between the payload (e.g., drug) and the Ig heavy chain polypeptide via the fGly residue, to form an Ig heavy chain polypeptide conjugate. A payload conjugated to an antibody of the present disclosure includes any suitable moiety (e.g., drug, detectable label, water soluble polymer, polypeptide, etc.) that, prior to conjugation to an fGly-modified antibody, can be functionalized to from an aldehyde-reactive reactive partner that includes an aldehyde-reactive group attached to the payload.

Thus, the present disclosure includes an antibody conjugate that includes a modified tag in an Ig heavy chain polypeptide conjugate, e.g., IgG1 heavy chain polypeptide conjugate, where the modified tag contains an amino acid sequence of the formula:

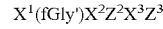   (III)

where fGly' is a formylglycine residue modified with a payload (e.g., drug) covalently attached thereto; $Z^2$ is either a proline or alanine residue (which can also be represented by (P/A)); $Z^3$ is a basic amino acid (e.g., arginine (R), and may be lysine (K) or histidine (H), usually lysine), or an aliphatic amino acid (alanine (A), glycine (G), leucine (L), valine (V), isoleucine (I), or proline (P), usually A, G, L, V, or I; $X^1$ is present or absent and, when present, can be any amino acid, though usually an aliphatic amino acid, a sulfur-containing amino acid, or a polar, uncharged amino acid, (i.e., other than a aromatic amino acid or a charged amino acid), usually L, M, V, S or T, more usually L, M, S or V; and $X^2$ and $X^3$ independently can be any amino acid, though usually an aliphatic amino acid, a polar, uncharged amino acid, or a sulfur containing amino acid (i.e., other than an aromatic amino acid or a charged amino acid), usually S, T, A, V, G or C, more usually S, T, A, V or G.

As the modified tag, having a payload (e.g., drug) conjugated thereto, may be derived from a converted tag, e.g., through the reaction of a aldehyde-reactive reactive partner containing the payload (e.g., drug with the aldehyde group of fGly, the position of the modified tag may be defined by the position of the converted tag in the Ig heavy chain polypeptide, which in turn may be defined by the position of the tag in the Ig heavy chain polypeptide, as described above. Thus in some embodiments, an antibody conjugate of the present disclosure includes an Ig heavy chain polypeptide conjugate that includes a modified tag having an amino acid sequence of the formula $X^1Z^1X^2Z^2X^3Z^3$, where $X^1$, $X^2$, $X^3$, $Z^2$ and $Z^3$ are as described above, and where $Z^1$ is fGly', where fGly' is a formylglycine residue modified with a payload (e.g., drug) covalently attached thereto, and where the Ig heavy chain polypeptide conjugate includes a constant region containing any one of the amino acid sequences set forth in SEQ ID NOs:179-369, shown in Tables 1-4, where $Z^1$ is fGly', where fGly' is a formylglycine residue modified with a payload (e.g., drug) covalently attached thereto, and where $X^1$, $X^2$, $X^3$, $Z^2$ and $Z^3$ are as described above. In some embodiments, the antibody conjugate includes an Ig heavy chain polypeptide conjugate containing in the constant region a conjugated tag having the formula: L(fGly')TPSR (SEQ ID NO:630). As described above, the antibody conjugate that includes a payload conjugated to the present antibody via an fGly of a converted tag in an Ig heavy chain polypeptide constant region may exhibit in solution a proportion of antibody monomers of about 20% or higher, e.g., 30% or higher, 40% or higher, 60% or higher, 80% or higher, including 90% or higher.

The structure of fGly' may vary, and may depend on the structure of the aldehyde-reactive group used to react a reactive partner containing the payload (e.g., drug) with the aldehyde side chain of the fGly residue in a converted tag of an fGly-modified Ig heavy chain polypeptide. fGly' may include any suitable linkage between the Ig polypeptide backbone and the payload (e.g., drug). In some cases, the payload (e.g., drug) is covalently bound to the converted tag through the fGly, which is modified, through its reaction with the aldehyde-reactive group, to form a hydrazone, oxime, semicarbazone (e.g., thiosemicarbozone), alkyl, alkenyl, acyloxy, hydrazinyl-indolyl, hydrazinyl-imidazoyl, hydrazinyl-pyrrolyl, hydrazinyl-furanyl or a pyrazalinone-derived linkage, and derivatives of such linkages, with the payload (e.g., drug). A hydrazinyl-indolyl linkage may include, e.g., a partially unsaturated pyrazole or pyridazine ring, or a partially unsaturated pyridazine or 1,2-diazepine ring. A pyrazalinone-derived linkage may include a cyclic linkage derived from a pyrazalinone. In some cases, a hydrazinyl-substituted heteroaryl ring-derived linkage includes a cyclic linkage derived from, e.g., a hydrazinyl-substituted 5-membered heteroaryl ring compound, where one or more atoms in the ring is a heteroatom (e.g., N, O or S). The hydrazinyl-substituted heteroaryl ring-derived linkage may include a hydrazinyl-imidazoyl, hydrazinyl-pyrrolyl, or a hydrazinyl-furanyl linkage. Suitable linkages between the fGly of a converted tag and the payload are described in, e.g., US20120183566, US20140141025, and WO2014074218, each of which is incorporated herein by reference.

The payload (e.g., drug), in some cases, may be covalently bound to the fGly of a converted tag via one or more linking groups, in addition to the covalent linkage formed by a reaction between the aldehyde-reactive group and the aldehyde group of fGly of the converted tag. Thus the linking group may serve as a spacer between the payload (e.g., drug) and the covalent linkage with the modified fGly of the tag in the Ig heavy chain polypeptide conjugate. The linking group may be any suitable linking group. In some cases, the linking group includes polyethylene glycol (PEG); amino acids; alkyl groups, including substituted alkyl groups; a protease cleavable group; esters; acyloxy groups, including substituted acyloxy groups, etc. Suitable linking groups are described in, e.g., US20150157736, which is incorporated by reference herein. In some embodiments, the linking group includes a 4-aminopiperidine (4AP) derivative.

An antibody conjugate of the present disclosure can include: 1) an Ig heavy chain constant region conjugated to a payload (e.g., drug) of interest; and an Ig light chain constant region that is not conjugated to a payload (e.g., drug); or 2) an Ig heavy chain constant region conjugated to a payload (e.g., drug); and an Ig light chain constant region conjugated to a payload (e.g., drug). A subject antibody conjugate can also include $V_H$ and/or $V_L$ domains.

An antibody conjugate can have any of a variety of antigen-binding specificities, as described above, including, e.g., an antigen present on a cancer cell; an antigen present on an autoimmune cell; an antigen present on a pathogenic microorganism; an antigen present on a virus-infected cell (e.g., a human immunodeficiency virus-infected cell), e.g., CD4 or gp120; an antigen present on a diseased cell; and the like. For example, an antibody conjugate can bind an antigen, as noted above, where the antigen is present on the surface of the cell. The binding specificity, affinity, etc., of the antibody conjugate may be determined by at least the light and heavy chain variable region CDR sequences and/or the light and heavy chain variable regions (including the framework regions) included in the antibody conjugate. Thus the binding specificity, affinity, etc., of the antibody conjugate typically may have substantially the same antigen binding specificity, affinity, etc., as an antibody that may not be conjugated to a payload, or be tagged, and which has at least the same light and heavy chain variable region CDR sequences and/or the same light and heavy chain variable regions as the antibody conjugate.

An antibody conjugate of the present disclosure can bind antigen with a suitable binding affinity, e.g., from about $5 \times 10^{-6}$ M to about $10^{-7}$ M, from about $10^{-7}$ M to about $5 \times 10^{-7}$ M, from about $5 \times 10^{-7}$ M to about $10^{-8}$ M, from about $10^{-8}$ M to about $5 \times 10^{-8}$ M, from about $5 \times 0^{-8}$ M to about $10^{-9}$ M, or a binding affinity greater than $10^{-9}$ M (i.e., $K_D$ less than $10^{-9}$ M).

As non-limiting examples, a subject antibody conjugate can bind an antigen present on a cancer cell (e.g., a tumor-specific antigen; an antigen that is over-expressed on a cancer cell; etc.), and the attached payload can be a cytotoxic compound (e.g., a cytotoxic small molecule, a cytotoxic synthetic peptide, etc.). For example, a subject antibody conjugate can be specific for CD19, where the attached payload is a cytotoxic compound (e.g., a cytotoxic small molecule, a cytotoxic synthetic peptide, etc.). As another example, a subject antibody conjugate can be specific for CD22, where the attached payload can be a cytotoxic compound (e.g., a cytotoxic small molecule, a cytotoxic synthetic peptide, etc.). Alternatively, a subject antibody conjugate can be specific for CD79b, where the attached payload can be a cytotoxic compound (e.g., a cytotoxic small molecule, a cytotoxic synthetic peptide, etc.). Alternatively, a subject antibody conjugate can be specific for CD33, where the attached payload can be a cytotoxic compound (e.g., a cytotoxic small molecule, a cytotoxic synthetic peptide, etc.).

As further non-limiting examples, a subject antibody conjugate can bind an antigen present on a cell infected with a virus (e.g., where the antigen is encoded by the virus; where the antigen is expressed on a cell type that is infected by a virus; etc.), and the payload can be a viral fusion inhibitor. For example, a subject antibody conjugate can bind CD4, and the attached payload can be a viral fusion inhibitor. As another example, a subject antibody conjugate can bind gp120, and the attached payload can be a viral fusion inhibitor.

As described above, a payload conjugated to an antibody of the present disclosure includes any suitable moiety (e.g., drug, detectable label, water soluble polymer, polypeptide, etc.) that, prior to conjugation to an fGly-modified antibody, can be functionalized to from an aldehyde-reactive reactive partner that includes an aldehyde-reactive group attached to the payload.

An antibody conjugate of the present disclosure can include, as the payload (e.g., drug), any of a variety of compounds, as described above, e.g., a drug (e.g., a peptide drug, a small molecule drug, and the like), a water-soluble polymer, a detectable label, a synthetic peptide, etc. In general, the payload or payloads (e.g., drug or drugs) can provide for one or more of a wide variety of functions or features. Moieties of interest include, without limitation, detectable labels (e.g., dye labels (e.g., chromophores, fluorophores), biophysical probes (spin labels, nuclear magnetic resonance (NMR) probes), Förster Resonance Energy Transfer (FRET)-type labels (e.g., at least one member of a FRET pair, including at least one member of a fluorophore/quencher pair), Bioluminescence Resonance Energy Transfer (BRET)-type labels (e.g., at least one member of a BRET pair), immunodetectable tags (e.g., FLAG (e.g., DYKDDDDK (SEQ ID NO:653)), His(6), and the like), localization tags (e.g., to identify association of a tagged polypeptide at the tissue or molecular cell level (e.g., association with a tissue type, or particular cell membrane)), and the like); light-activated dynamic moieties (e.g., azobenzene mediated pore closing, azobenzene mediated structural changes, photodecaging recognition motifs); water soluble polymers (e.g., PEGylation); purification tags (e.g., to facilitate isolation by affinity chromatography (e.g., attachment of a FLAG epitope, e.g., DYKDDDDK (SEQ ID NO:653)); membrane localization domains (e.g., lipids or glycophosphatidylinositol (GPI)-type anchors); immobilization tags (e.g., to facilitate attachment of the polypeptide to a surface, including selective attachment); drugs (e.g., to facilitate drug targeting, e.g., through attachment of the drug to an antibody); toxins; targeted delivery moieties, (e.g., ligands for binding to a target receptor (e.g., to facilitate viral attachment, attachment of a targeting protein present on a liposome, etc.)), other molecules for delivery to the cell and which can provide for a pharmacological activity or can serve as a target for delivery of other molecules, and the like.

Also contemplated is a covalently attached payload (e.g., drug) that comprises one of a pair of binding partners (e.g., a ligand, a ligand-binding portion of a receptor, a receptor-binding portion of a ligand, etc.). For example, the payload can comprise a polypeptide that serves as a viral receptor and, upon binding with a viral envelope protein or viral capsid protein, facilitates attachment of virus to the cell surface with which the antibody conjugate is associated, e.g., is bound. Alternatively, the payload comprises an antigen that is specifically bound by an antibody (e.g., monoclonal antibody), to facilitate detection and/or separation of host cells bound to the antibody conjugate containing the payload.

Water-Soluble Polymers

In some cases, an antibody conjugate comprises a covalently linked payload that is a water-soluble polymer. A moiety of particular interest is a water-soluble polymer. A "water-soluble polymer" refers to a polymer that is soluble in water and is usually substantially non-immunogenic, and usually has an atomic molecular weight greater than about 1,000 Daltons. The methods and compositions described herein can be used to attach one or more water-soluble polymers to a tagged and converted polypeptide. Attachment of a water-soluble polymer (e.g., PEG) of a polypeptide, particularly a pharmaceutically active (therapeutic) polypeptide can be desirable as such modification can increase therapeutic index by increasing serum half-life as a result of increased proteolytic stability and/or decreased renal clearance. Additionally, attachment of one or more polymers (e.g., PEGylation) can reduce immunogenicity of protein pharmaceuticals.

In some embodiments, the water-soluble polymer has an effective hydrodynamic molecular weight of greater than about 10,000 Da, greater than about 20,000 to 500,000 Da, greater than about 40,000 Da to 300,000 Da, greater than about 50,000 Da to 70,000 Da, usually greater than about 60,000 Da. In some embodiments, the water-soluble polymer has an effective hydrodynamic molecular weight of from about 10 kDa to about 20 kDa, from about 20 kDa to about 25 kDa, from about 25 kDa to about 30 kDa, from about 30 kDa to about 50 kDa, or from about 50 kDa to about 100 kDa. By "effective hydrodynamic molecular weight" is intended the effective water-solvated size of a polymer chain as determined by aqueous-based size exclusion chromatography (SEC). When the water-soluble polymer contains polymer chains having polyalkylene oxide repeat units, such as ethylene oxide repeat units, each chain can have an atomic molecular weight of between about 200 Da and about 80,000 Da, or between about 1,500 Da and about 42,000 Da, with 2,000 to about 20,000 Da being of particular interest. Unless referred to specifically, molecular weight is intended to refer to atomic molecular weight. Linear, branched, and terminally charged water soluble polymers (e.g., PEG) are of particular interest.

Polymers useful as moieties to be conjugated to an fGly-modified antibody to form an antibody conjugate can have a wide range of molecular weights, and polymer subunits. These subunits may include a biological polymer, a synthetic polymer, or a combination thereof. Examples of such water-soluble polymers include: dextran and dextran derivatives, including dextran sulfate, P-amino cross linked dextrin, and carboxymethyl dextrin, cellulose and cellulose derivatives, including methylcellulose and carboxymethyl cellulose, starch and dextrines, and derivatives and hydroylactes of starch, polyalklyene glycol and derivatives thereof, including polyethylene glycol, methoxypolyethylene glycol, polyethylene glycol homopolymers, polypropylene glycol homopolymers, copolymers of ethylene glycol with propylene glycol, wherein said homopolymers and copolymers are unsubstituted or substituted at one end with an alkyl group, heparin and fragments of heparin, polyvinyl alcohol and polyvinyl ethyl ethers, polyvinylpyrrolidone, aspartamide, and polyoxyethylated polyols, with the dextran and dextran derivatives, dextrine and dextrine derivatives. It will be appreciated that various derivatives of the specifically recited water-soluble polymers are also contemplated.

Water-soluble polymers such as those described above are well known, particularly the polyalkylene oxide based polymers such as polyethylene glycol "PEG". Suitable polymers include, without limitation, those containing a polyalkylene oxide, polyamide alkylene oxide, or derivatives thereof, including polyalkylene oxide and polyamide alkylene oxide comprising an ethylene oxide repeat unit of the formula $-(CH_2-CH_2-O)-$. Further exemplary polymers of interest include a polyamide having a molecular weight greater than about 1,000 Daltons of the formula —[C(O)—X—C(O)—NH—Y—NH]n- or —[NH—Y—NH—C(O)—X—C(O)]$_n$—, where X and Y are divalent radicals that may be the same or different and may be branched or linear, and n is a discrete integer from 2-100, usually from 2 to 50, and where either or both of X and Y comprises a biocompatible, substantially non-antigenic water-soluble repeat unit that may be linear or branched. Further exemplary water-soluble repeat units comprise an ethylene oxide of the formula —(CH$_2$—CH$_2$—O)— or —(CH$_2$—CH$_2$—O)—. The number of such water-soluble repeat units can vary significantly, with the usual number of such units being from 2 to 500, 2 to 400, 2 to 300, 2 to 200, 2 to 100, and most usually 2 to 50. An exemplary embodiment is one in which one or both of X and Y is selected from: —((CH$_2$)$_{n1}$—(CH$_2$—CH$_2$—O)$_{n2}$—(CH$_2$)— or —((CH$_2$)$_{n1}$—(O)—CH$_2$—CH$_2$)$_{n2}$—(CH$_2$)$_{n-1}$—), where n1 is 1 to 6, 1 to 5, 1 to 4 and most usually 1 to 3, and where n2 is 2 to 50, 2 to 25, 2 to 15, 2 to 10, 2 to 8, and most usually 2 to 5. A further exemplary embodiment is one in which X is —(CH$_2$—CH$_2$)—, and where Y is —(CH$_2$—(CH$_2$—CH$_2$—O)$_3$—CH$_2$—CH$_2$—CH$_2$)— or —(CH$_2$—CH$_2$—CH$_2$—(O—CH$_2$—CH$_2$)$_3$—CH$_2$)—.

The polymer can include one or more spacers or linkers. Exemplary spacers or linkers include linear or branched moieties comprising one or more repeat units employed in a water-soluble polymer, diamino and or diacid units, natural or unnatural amino acids or derivatives thereof, as well as aliphatic moieties, including alkyl, aryl, heteroalkyl, heteroaryl, alkoxy, and the like, which can contain, for example, up to 18 carbon atoms or even an additional polymer chain.

The polymer moiety, or one or more of the spacers or linkers of the polymer moiety when present, may include polymer chains or units that are biostable or biodegradable. For example, polymers with repeat linkages have varying degrees of stability under physiological conditions depending on bond lability. Polymers with such bonds can be categorized by their relative rates of hydrolysis under physiological conditions based on known hydrolysis rates of low molecular weight analogs, e.g., from less stable to more stable, e.g., polyurethanes (—NH—C(O)—O—)>polyorthoesters (—O—C((OR)(R'))—O—)>polyamides (—C(O)—NH—). Similarly, the linkage systems attaching a water-soluble polymer to a target molecule may be biostable or biodegradable, e.g., from less stable to more stable: carbonate (—O—C(O)—O—)>ester (—C(O)—O—)>urethane (—NH—C(O)—O—)>orthoester (—O—C((OR)(R'))—O—)>amide (—C(O)—NH—). In general, it may be desirable to avoid use of sulfated polysaccharide, depending on the lability of the sulfate group. In addition, it may be less desirable to use polycarbonates and polyesters. These bonds are provided by way of example, and are not intended to limit the types of bonds employable in the polymer chains or linkage systems of the water-soluble polymers useful in the modified aldehyde tagged polypeptides disclosed herein.

Synthetic Peptides

In some cases, an antibody conjugate comprises a covalently linked peptide, e.g., a peptide covalently linked to fGly of a converted tag of an Ig heavy chain polypeptide of an antibody. Suitable peptides include, but are not limited to, cytotoxic peptides; angiogenic peptides; anti-angiogenic peptides; peptides that activate B cells; peptides that activate T cells; anti-viral peptides; peptides that inhibit viral fusion; peptides that increase production of one or more lymphocyte populations; anti-microbial peptides; growth factors; growth hormone-releasing factors; vasoactive peptides; anti-inflammatory peptides; peptides that regulate glucose metabolism; an anti-thrombotic peptide; an anti-nociceptive peptide; a vasodilator peptide; a platelet aggregation inhibitor; an analgesic; and the like.

Where the covalently attached moiety is a peptide, the peptide can be chemically synthesized to include a group reactive with a converted fGly-containing Ig polypeptide. A suitable synthetic peptide has a length of from about 5 amino acids to about 100 amino acids, or longer than 100 amino acids; e.g., a suitable peptide has a length of from about 5 amino acids (aa) to about 10 aa, from about 10 aa to about 15 aa, from about 15 aa to about 20 aa, from about 20 aa to about 25 aa, from about 25 aa to about 30 aa, from about 30 aa to about 40 aa, from about 40 aa to about 50 aa, from about 50 aa to about 60 aa, from about 60 aa to about 70 aa, from about 70 aa to about 80 aa, from about 80 aa to about 90 aa, or from about 90 aa to about 100 aa.

A peptide can be modified to contain an α-nucleophile-containing moiety (e.g., an aminooxy or hydrazide moiety), e.g., can be reacted with the fGly-containing Ig polypeptide to yield a conjugate in which the aldehyde-tagged Ig polypeptide and peptide are linked by a hydrazone or oxime bond, respectively. Exemplary methods of synthesizing a peptide, such that the synthetic peptide comprising a reactive group reactive with a converted aldehyde tag, are described above.

Suitable peptides include, but are not limited to, hLF-11 (an 11-amino acid N-terminal fragment of lactoferrin), an anti-microbial peptide; granulysin, an anti-microbial peptide; Plectasin (NZ2114; SAR 215500), an anti-microbial peptide; viral fusion inhibitors such as Fuzeon (enfuvirtide), TRI-1249 (T-1249; see, e.g., Matos et al. (2010) *PLoS One* 5:e9830), TRI-2635 (T-2635; see, e.g., Eggink et al. (2009) *J. Biol. Chem.* 284:26941), T651, and TRI-1144; C5a receptor inhibitors such as PMX-53, JPE-1375, and JSM-7717; POT-4, a human complement factor C3 inhibitor; Pancreate (an INGAP derivative sequence, a HIP-human proislet protein); somatostatin; a somatostatin analog such as DEBIO 8609 (Sanvar), octreotide, octreotide (C2L), octreotide QLT, octreotide LAR, Sandostatin LAR, SomaLAR, Somatuline (lanreotide), see, e.g., Deghenghi et al. (2001) *Endocrine* 14:29; TH9507 (Tesamorelin, a growth hormone-releasing factor); POL7080 (a protegrin analog, an anti-microbial peptide); relaxin; a corticotropin releasing factor agonist such as urotensin, sauvagine, and the like; a heat shock protein derivative such as DiaPep277; a human immunodeficiency virus entry inhibitor; a heat shock protein-20 mimic such as AZX100; a thrombin receptor activating peptide such as TP508 (Chrysalin); a urocortin 2 mimic (e.g., a CRF2 agonist) such as urocortin-2; an immune activator such as Zadaxin (thymalfasin; thymosin-al), see, e.g., Sjogren (2004) *J. Gastroenterol. Hepatol.* 19: S69; a hepatitis C virus (HCV) entry inhibitorE2 peptide such as HCV3; an atrial natriuretic peptide such as HANP (Sun 4936; carperitide); an annexin peptide; a defensin (anti-microbial peptide) such as hBD2-4; a defensin (anti-microbial peptide) such as hBD-3; a defensin (anti-microbial peptide) such as PMX-30063; a histatin (anti-microbial peptide) such as histatin-3, histatin-5, histatin-6, and histatin-9; a histatin (anti-microbial peptide) such as PAC-113; an indolicidin (anti-microbial peptide) such as MX-594AN (Omniganin; CLS001); an indolicidin (anti-microbial peptide) such as Omnigard (MBI-226; CPI-226); an anti-microbial peptide such as an insect cecropin; an anti-microbial peptide such as a lactoferrin (talactoferrin); an LL-37/cathelicidin derivative (an anti-microbial peptide) such as P60.4 (OP-145); a magainin (an anti-microbial peptide) such as Pexiganan (MSI-78; Suponex); a protegrin (an anti-microbial peptide) such as IB-367 (Iseganan); an agan peptide; a beta-natriuretic peptide such as Natrecor, or Noratak (Nesiritide), or ularitide; bivalarudin (Angiomax); a thrombin inhibitor; a C peptide derivative; a calcitonin such as Miacalcin (Fortical); an enkephalin derivative; an erythropoiesis-stimulating peptide such as Hematide; a gap junction modulator such as Danegaptide (ZP1609); a gastrin-releasing peptide; a ghrelin; a glucagon-like peptide; a glucagon-like peptide-2 analog such as ZP1846 or ZP1848; a glucosaminyl muramyl dipeptide such as GMDP; a glycopeptide antibiotic such as Oritavancin; a teicoplanin derivative such as Dalbavancin; a gonadotropin releasing hormone (GnRH) such as Zoladex (Lupon) or Triptorelin; a histone deacetylase (HDAC) inhibitor depsipeptide such as PM02734 (Irvalec); an integrin such as eptifibatide; an insulin analog such as Humulog; a kahalalide depsipeptide such as PM02734; a kallikrein inhibitor such as Kalbitor (ecallantide); an antibiotic such as Telavancin; a lipopeptide such as Cubicin or MX-2401; a lutenizing hormone releasing hormone (LHRH) such as goserelin; an LHRH synthetic decapeptide agonist analog such as Treistar (triptorelin pamoate); an LHRH such as Eligard; an M2 protein channel peptide inhibitor; metreleptin; a melanocortin receptor agonist peptide such as bremalanotide/PT-141; a melanocortin; a muramyl tripeptide such as Mepact (mifamurtide); a myelin basic protein peptide such as MBP 8298 (dirucotide); an N-type voltage-gated calcium channel blocker such as Ziconotide (Prialt); a parathyroid hormone peptide; a parathyroid analog such as 768974; a peptide hormone analog such as UGP281; a prostaglandin F2-α receptor inhibitor such as PDC31; a protease inhibitor such as PPL-100; surfaxin; a thrombospondin-1 (TSP-1) mimetic such as CVX-045 or ABT 510; a vasoactive intestinal peptide; vasopressin; a Y2R agonist peptide such as RG7089; obinepeptide; and TM30339.

Drugs as a Payload Conjugated to an Antibody

The payload conjugated to an antibody of the present disclosure may be any of a number of drugs. Exemplary drugs include small molecule drugs and peptide drugs. Thus, the present disclosure provides drug-antibody conjugates, where a drug is covalently linked to fGly of a converted tag of an Ig heavy chain polypeptide of an antibody.

"Small molecule drug" as used herein refers to a compound, e.g., an organic compound, which exhibits a pharmaceutical activity of interest and which is generally of a molecular weight of no greater than about 800 Da, or no greater than 2000 Da, but can encompass molecules of up to 5 kDa and can be as large as about 10 kDa. A small inorganic molecule refers to a molecule containing no carbon atoms, while a small organic molecule refers to a compound containing at least one carbon atom.

"Peptide drug" as used herein refers to amino-acid containing polymeric compounds, and is meant to encompass naturally-occurring and non-naturally-occurring peptides, oligopeptides, cyclic peptides, polypeptides, and proteins, as well as peptide mimetics. The peptide drugs may be obtained by chemical synthesis or be produced from a genetically encoded source (e.g., recombinant source). Peptide drugs can range in molecular weight, and can be from 200 Da to 10 kDa or greater in molecular weight.

In some cases, the drug is a cancer chemotherapeutic agent. For example, where an antibody has specificity for a tumor cell, the antibody can be modified as described herein to include an aldehyde tag, can be subsequently converted to an fGly-modified antibody, and can then be conjugated to a cancer chemotherapeutic agent. Cancer chemotherapeutic agents include non-peptidic (i.e., non-proteinaceous) compounds that reduce proliferation of cancer cells, and encompass cytotoxic agents and cytostatic agents. Non-limiting examples of chemotherapeutic agents include alkylating agents, nitrosoureas, antimetabolites, antitumor antibiotics, plant (vinca) alkaloids, and steroid hormones. Peptidic compounds can also be used.

Suitable cancer chemotherapeutic agents include dolastatin and active analogs and derivatives thereof; and auristatin and active analogs and derivatives thereof. See, e.g., WO 96/33212, WO 96/14856, and U.S. Pat. No. 6,323,315. For example, dolastatin 10 or auristatin PE can be included in an antibody-drug conjugate of the present disclosure. Suitable cancer chemotherapeutic agents also include maytansinoids and active analogs and derivatives thereof (see, e.g., EP 1391213; and Liu et al (1996) Proc. Natl. Acad. Sci. USA 93:8618-8623); and duocarmycins and active analogs and derivatives thereof (e.g., including the synthetic analogues, KW-2189 and CB 1-TM1). In some cases, the cancer chemotherapeutic agent includes a pyrrolobenzodiazepine compound.

Agents that act to reduce cellular proliferation are known in the art and widely used. Such agents include alkylating agents, such as nitrogen mustards, nitrosoureas, ethylenimine derivatives, alkyl sulfonates, and triazenes, including, but not limited to, mechlorethamine, cyclophosphamide (Cytoxan™), melphalan (L-sarcolysin), carmustine (BCNU), lomustine (CCNU), semustine (methyl-CCNU), streptozocin, chlorozotocin, uracil mustard, chlormethine, ifosfamide, chlorambucil, pipobroman, triethylenemelamine, triethylenethiophosphoramine, busulfan, dacarbazine, and temozolomide.

Antimetabolite agents include folic acid analogs, pyrimidine analogs, purine analogs, and adenosine deaminase inhibitors, including, but not limited to, cytarabine (CYTOSAR-U), cytosine arabinoside, fluorouracil (5-FU), floxuridine (FudR), 6-thioguanine, 6-mercaptopurine (6-MP), pentostatin, 5-fluorouracil (5-FU), methotrexate, 10-propargyl-5,8-dideazafolate (PDDF, CB3717), 5,8-dideazatetrahydrofolic acid (DDATHF), leucovorin, fludarabine phosphate, pentostatine, and gemcitabine.

Suitable natural products and their derivatives, (e.g., vinca alkaloids, antitumor antibiotics, enzymes, lymphokines, and epipodophyllotoxins), include, but are not limited to, Ara-C, paclitaxel (Taxol®), docetaxel (Taxotere®), deoxycoformycin, mitomycin-C, L-asparaginase, azathioprine; brequinar; alkaloids, e.g. vincristine, vinblastine, vinorelbine, vindesine, etc.; podophyllotoxins, e.g. etoposide, teniposide, etc.; antibiotics, e.g. anthracycline, daunorubicin hydrochloride (daunomycin, rubidomycin, cerubidine), idarubicin, doxorubicin, epirubicin and morpholino derivatives, etc.; phenoxizone biscyclopeptides, e.g. dactinomycin; basic glycopeptides, e.g. bleomycin; anthraquinone glycosides, e.g. plicamycin (mithramycin); anthracenediones, e.g. mitoxantrone; azirinopyrrolo indolediones, e.g. mitomycin; macrocyclic immunosuppressants, e.g. cyclosporine, FK-506 (tacrolimus, prograf), rapamycin, etc.; and the like.

Other anti-proliferative cytotoxic agents are navelbene, CPT-11, anastrazole, letrazole, capecitabine, reloxafine, cyclophosphamide, ifosamide, and droloxafine.

Microtubule affecting agents that have antiproliferative activity are also suitable for use and include, but are not limited to, allocolchicine (NSC 406042), Halichondrin B (NSC 609395), colchicine (NSC 757), colchicine derivatives (e.g., NSC 33410), dolstatin 10 (NSC 376128), maytansine (NSC 153858), rhizoxin (NSC 332598), paclitaxel (Taxol®), Taxol® derivatives, docetaxel (Taxotere®), thiocolchicine (NSC 361792), trityl cysterin, vinblastine sulfate, vincristine sulfate, natural and synthetic epothilones including but not limited to, eopthilone A, epothilone B, discodermolide; estramustine, nocodazole, and the like.

Hormone modulators and steroids (including synthetic analogs) that are suitable for use include, but are not limited to, adrenocorticosteroids, e.g. prednisone, dexamethasone, etc.; estrogens and pregestins, e.g. hydroxyprogesterone caproate, medroxyprogesterone acetate, megestrol acetate, estradiol, clomiphene, tamoxifen; etc.; and adrenocortical suppressants, e.g. aminoglutethimide; 17α-ethinylestradiol; diethylstilbestrol, testosterone, fluoxymesterone, dromostanolone propionate, testolactone, methylprednisolone, methyl-testosterone, prednisolone, triamcinolone, chlorotrianisene, hydroxyprogesterone, aminoglutethimide, estramustine, medroxyprogesterone acetate, leuprolide, Flutamide (Drogenil), Toremifene (Fareston), and Zoladex®. Estrogens stimulate proliferation and differentiation; therefore compounds that bind to the estrogen receptor are used to block this activity. Corticosteroids may inhibit T cell proliferation.

Other suitable chemotherapeutic agents include metal complexes, e.g. cisplatin (cis-DDP), carboplatin, etc.; ureas, e.g. hydroxyurea; and hydrazines, e.g. N-methylhydrazine; epidophyllotoxin; a topoisomerase inhibitor; procarbazine; mitoxantrone; leucovorin; tegafur; etc. Other anti-proliferative agents of interest include immunosuppressants, e.g. mycophenolic acid, thalidomide, desoxyspergualin, azasporine, leflunomide, mizoribine, azaspirane (SKF 105685); Iressa® (ZD 1839, 4-(3-chloro-4-fluorophenylamino)-7-methoxy-6-(3-(4-morpholinyl)propoxy)quinazoline); etc.

Taxanes are suitable for use. "Taxanes" include paclitaxel, as well as any active taxane derivative or pro-drug. "Paclitaxel" (which should be understood herein to include analogues, formulations, and derivatives such as, for example, docetaxel, TAXOL™, TAXOTERE™ (a formulation of docetaxel), 10-desacetyl analogs of paclitaxel and 3'N-desbenzoyl-3'N-t-butoxycarbonyl analogs of paclitaxel) may be readily prepared utilizing techniques known to those skilled in the art (see also WO 94/07882, WO 94/07881, WO 94/07880, WO 94/07876, WO 93/23555, WO 93/10076; U.S. Pat. Nos. 5,294,637; 5,283,253; 5,279,949; 5,274,137; 5,202,448; 5,200,534; 5,229,529; and EP 590,267), or obtained from a variety of commercial sources, including for example, Sigma Chemical Co., St. Louis, Mo. (T7402 from *Taxus brevifolia*; or T-1912 from *Taxus yannanensis*).

Paclitaxel should be understood to refer to not only the common chemically available form of paclitaxel, but analogs and derivatives (e.g., Taxotere™ docetaxel, as noted above) and paclitaxel conjugates (e.g., paclitaxel-PEG, paclitaxel-dextran, or paclitaxel-xylose).

Also included within the term "taxane" are a variety of known derivatives, including both hydrophilic derivatives, and hydrophobic derivatives. Taxane derivatives include, but not limited to, galactose and mannose derivatives described in International Patent Application No. WO 99/18113; piperazino and other derivatives described in WO 99/14209; taxane derivatives described in WO 99/09021, WO 98/22451, and U.S. Pat. No. 5,869,680; 6-thio derivatives described in WO 98/28288; sulfenamide derivatives described in U.S. Pat. No. 5,821,263; and taxol derivative described in U.S. Pat. No. 5,415,869. It further includes prodrugs of paclitaxel including, but not limited to, those described in WO 98/58927; WO 98/13059; and U.S. Pat. No. 5,824,701.

Biological response modifiers suitable for use include, but are not limited to, (1) inhibitors of tyrosine kinase (RTK) activity; (2) inhibitors of serine/threonine kinase activity; (3) tumor-associated antigen antagonists, such as antibodies that bind specifically to a tumor antigen; (4) apoptosis receptor agonists; (5) interleukin-2; (6) IFN-α; (7) IFN-γ; (8) colony-stimulating factors; and (9) inhibitors of angiogenesis.

Fc RECEPTOR BINDING

An antibody conjugate, and/or an fGly-modified but unconjugated antibody, of the present disclosure may show increased or reduced binding to one or more Fcγ receptors (e.g., CD16a, CD64, FcRn, etc.) compared to its parent antibody that does not include a tag sequence in its Ig heavy chain constant region. In some embodiments, the antibody conjugate, and/or the fGly-modified but unconjugated antibody, binds less effectively to one or more Fcγ receptors (e.g., CD16a and/or CD64) than its parent antibody that does not include a tag sequence in its Ig heavy chain constant region. In certain cases, the antibody conjugate, and/or the fGly-modified but unconjugated antibody, exhibits binding to CD16a (FcγRIIIa) that is about 0.8 fold or less, e.g., about 0.6 fold or less, including about 0.5 fold or less compared to its parent antibody that does not include a tag sequence in its Ig heavy chain constant region. In certain cases, the antibody conjugate, and/or the fGly-modified but unconjugated antibody, exhibits binding to CD16a (FcγRIIIa) that is in the range of from about 0.8 fold to about 0.1 fold, e.g., from about 0.6 fold to about 0.3 fold, including from about 0.5 fold to about 0.4 fold compared to its parent antibody that does not include a tag sequence in its Ig heavy chain constant region. In certain cases, the antibody conjugate, and/or a tagged but unconjugated antibody, exhibits binding to CD64 (FcγRI) that is about 0.8 fold or less, e.g., about 0.6 fold or less, about 0.4 fold or less, about 0.2 fold or less, including about 0.1 fold or less compared to its parent antibody that does not include a tag sequence in its Ig heavy chain constant region. In certain cases, the antibody conjugate, and/or the fGly-modified but unconjugated antibody, exhibits binding to CD64 (FcγRI) that is in the range of from about 0.8 fold to about 0.05 fold, e.g., from about 0.6 fold to about 0.05 fold, from about 0.4 fold to about 0.05 fold, including from about 0.2 fold to about 0.1 fold, compared to its parent antibody that does not include a tag sequence in its Ig heavy chain constant region. The binding between an antibody conjugate, or a tagged but unconjugated antibody, and an Fc receptor may be measured using, e.g., an ELISA assay, or a biosensor system (such as the Forte Bio Octet system). Without being bound to theory, the presence of the tag and/or the conjugated payload in the Ig heavy chain constant region may interfere, directly (e.g., by steric hindrance) or indirectly (e.g., through allosteric effects), with the ability of the Fc region to bind an Fcγ receptor, such as CD16a or CD64, and as a result, may reduce off-target toxicity and/or reduce ADCC when the antibody conjugate is administered to an individual.

In certain cases, an antibody conjugate, and/or an fGly-modified but unconjugated antibody, exhibits binding to CD16a (FcγRIIIa) that is about 0.8 fold or less, e.g., about 0.6 fold or less, including about 0.5 fold or less compared to its parent antibody that does not include a tag sequence in its Ig heavy chain constant region, and exhibits binding to CD64 (FcγRI) that is about 0.8 fold or less, e.g., about 0.6 fold or less, about 0.4 fold or less, about 0.2 fold or less, including about 0.1 fold or less compared to its parent antibody that does not include a tag sequence in its Ig heavy chain constant region. In certain cases, the antibody conjugate, and/or the fGly-modified but unconjugated antibody, exhibits binding to CD16a (FcγRIIIa) that is in the range of from about 0.8 fold to about 0.1 fold, e.g., from about 0.6 fold to about 0.3 fold, including from about 0.5 fold to about 0.4 fold compared to its parent antibody that does not include a tag sequence in its Ig heavy chain constant region, and exhibits binding to CD64 (FcγRI) that is in the range of from about 0.8 fold to about 0.05 fold, e.g., from about 0.6 fold to about 0.05 fold, from about 0.4 fold to about 0.05 fold, including from about 0.2 fold to about 0.1 fold, compared to its parent antibody that does not include a tag sequence in its Ig heavy chain constant region.

In certain embodiments, an antibody conjugate, and/or an fGly-modified but unconjugated antibody, that includes an Ig heavy chain constant region with a tag sequence positioned adjacent and N-terminal to an amino acid residue corresponding to positions 116, 185 or 227 of SEQ ID NO:1 exhibits reduced binding to CD16a and/or CD64, compared to its parent antibody that does not include a tag sequence in its Ig heavy chain constant region. In some embodiments, the tagged antibody includes a tagged Ig heavy chain polypeptide, where the tag contains an amino acid sequence of the formula $X^1Z^1X^2Z^2X^3Z^3$, where $X^1$, $X^2$, $X^3$, $Z^1$, $Z^2$ and $Z^3$ are as described above (in ", and where the Ig heavy chain polypeptide includes a constant region containing the amino acid sequence set forth in SEQ ID NOs:268, 269, 294 or 310. In some embodiments, the tag contains the amino acid sequence LCTPSR (SEQ ID NO:561). In some embodiments, the tag of the fGly-modified antibody is a converted tag, where $Z^1$ is fGly. In some embodiments, the converted tag includes the amino acid sequence L(fGly)TPSR (SEQ ID NO:607). In some embodiments, the antibody conjugate includes a tagged Ig heavy chain polypeptide conjugated to a payload, where the tagged Ig heavy chain polypeptide includes the amino acid sequence set forth in SEQ ID NO:459, 460, 485, 501. In some embodiments, the antibody conjugate includes, in the constant region of an Ig heavy chain polypeptide, a conjugated tag having the formula: L(fGly')TPSR (SEQ ID NO:630). In certain embodiments, the antibody includes a tagged Ig heavy chain polypeptide containing a constant region having the amino acid sequence set forth in SEQ ID NO:85, 109 or 122.

In certain embodiments, an antibody conjugate, and/or an fGly-modified but unconjugated antibody, that includes an Ig heavy chain constant region with a tag sequence positioned adjacent and N-terminal to an amino acid residue corresponding to position 185 of SEQ ID NO:1 exhibits reduced binding to CD16a and CD64, compared to its parent antibody that does not include a tag sequence in its Ig heavy chain constant region, as described above. In some embodiments, the tagged antibody includes a tagged Ig heavy chain polypeptide, where the tag contains an amino acid sequence of the formula $X^1Z^1X^2Z^2X^3Z^3$, where $X^1$, $X^2$, $X^3$, $Z^1$, $Z^2$ and $Z^3$ are as described above (in ", and where the Ig heavy chain polypeptide includes a constant region containing the amino acid sequence set forth in SEQ ID NO:294. In some embodiments, the tag contains the amino acid sequence LCTPSR (SEQ ID NO:561). In some embodiments, the tag of the fGly-modified antibody is a converted tag, where $Z^1$ is fGly. In some embodiments, the converted tag includes the amino acid sequence L(fGly)TPSR (SEQ ID NO:607). In some embodiments, the antibody conjugate includes a tagged Ig heavy chain polypeptide conjugated to a payload, where the tagged Ig heavy chain polypeptide includes the amino acid sequence set forth in SEQ ID NO:485. In some embodiments, the antibody conjugate includes, in the constant region of an Ig heavy chain polypeptide, a conjugated tag having the formula: L(fGly')TPSR (SEQ ID NO:630). In certain embodiments, the antibody includes a tagged Ig heavy chain polypeptide containing a constant region having the amino acid sequence set forth in SEQ ID NO:109.

In some cases, the insertion of the tag in the Ig heavy chain constant region and/or conjugation of a payload thereto enhances binding of the antibody or antibody conjugate to an Fc receptor (e.g., CD16a or CD64). Thus, in certain cases, an antibody conjugate, and/or an fGly-modified but unconjugated antibody, exhibits binding to CD16a (FcγRIIIa) that is about 1.5 fold or more, e.g., about 2 fold or more, about 3 fold or more, about 4 fold or more, about 5 fold or more, about 10 fold or more, including about 15 fold or more, compared to its parent antibody that does not include a tag sequence in its Ig heavy chain constant region. In certain cases, the antibody conjugate, and/or the fGly-modified but unconjugated antibody, exhibits binding to CD16a (FcγRIIIa) that is in the range of from about 1.5 fold to about 15 fold, e.g., from about 2 fold to about 15 fold, from about 3 fold to about 10 fold, including from about 5 fold to about 10 fold compared to its parent antibody that does not include a tag sequence in its Ig heavy chain constant region.

In some cases, an fGly-modified but unconjugated antibody exhibits a reduced binding to an Fcγ receptor(s) (e.g., CD16a and/or CD64), compared to the parent antibody that does not include a tag sequence in its Ig heavy chain constant region, and the antibody conjugate derived from the tagged antibody exhibits an increased binding to the same Fcγ receptor(s), compared to the parent antibody that does not include a tag sequence in its Ig heavy chain constant region. Thus, conjugation of the payload may serve as "switch," from weak binding of an Fcγ receptor when the tagged antibody is unconjugated, as described above, to strong bindng of the Fcγ receptor when the tagged antibody is conjugated to the payload, as described above.

In certain embodiments, an fGly-modified antibody that includes an Ig heavy chain constant region with a tag sequence positioned adjacent and N-terminal to an amino acid residue corresponding to position 116 of SEQ ID NO:1 exhibits reduced binding to CD16a, compared to its parent antibody that does not include a tag sequence in its Ig heavy chain constant region, as described above, and when the fGly-modified antibody is conjugated to a payload, exhibits enhanced binding to CD16a, compared to its parent antibody that does not include a tag sequence in its Ig heavy chain constant region, as described above. In some embodiments, the tagged antibody includes a tagged Ig heavy chain polypeptide, where the tag contains an amino acid sequence of the formula $X^1Z^1X^2Z^2X^3Z^3$, where $X^1$, $X^2$, $X^3$, $Z^1$, $Z^2$ and $Z^3$ are as described above (in ", and where the Ig heavy chain polypeptide includes a constant region containing the amino acid sequence set forth in SEQ ID NOs:268 or 269. In some embodiments, the tag contains the amino acid sequence LCTPSR (SEQ ID NO:561). In some embodiments, the tag of the fGly-modified antibody is a converted tag, where $Z^1$ is fGly. In some embodiments, the converted tag includes the amino acid sequence L(fGly)TPSR (SEQ ID NO:607). In some embodiments, the antibody conjugate includes a tagged Ig heavy chain polypeptide conjugated to a payload, where the tagged Ig heavy chain polypeptide includes the amino acid sequence set forth in SEQ ID NO:459 or 460. In some embodiments, the antibody conjugate includes, in the constant region of an Ig heavy chain polypeptide, a conjugated tag having the formula: L(fGly')TPSR (SEQ ID NO:630). In certain embodiments, the antibody includes a tagged Ig heavy chain polypeptide containing a constant region having the amino acid sequence set forth in SEQ ID NO:85.

In certain embodiments, the antibody conjugate binds to one or more Fcγ receptors (e.g., FcRn) at an endosomal pH, e.g., an acidic pH, such as from about pH 5.0 to about pH 6.0, including about pH 5.5, more effectively its parent antibody that does not include a tag sequence in its Ig heavy chain constant region. In certain cases, the antibody conjugate exhibits binding to FcRn at an acidic pH, such as about pH 5.5, that is about 1.1 fold or more, e.g., about 1.2 fold or more, about 1.5 fold or more, about 2 fold or more, about 3 fold or more, including about 5 fold or more compared to its parent antibody that does not include a tag sequence in its Ig heavy chain constant region. In certain cases, the antibody conjugate exhibits binding to FcRn at an acidic pH, such as about pH 5.5, that is in the range of from about 1.1 fold to about 8 fold, e.g., from about 1.2 fold to about 7 fold, from about 1.5 fold to about 6 fold, including from about 2 fold to about 5 fold compared to its parent antibody that does not include a tag sequence in its Ig heavy chain constant region. Without being bound to theory, the presence of the tag and/or the conjugated payload in the Ig heavy chain constant region of the present antibody conjugate may promote binding of the Fc region of the Ig heavy chain to FcRn in the acidic endosomal compartment upon internalization of the antibody conjugate by a cell, e.g., an endothelial cell or a monocyte.

In certain embodiments, the antibody conjugate binds to one or more Fcγ receptors (e.g., FcRn) at physiological pH, e.g., from about pH 7.0 to about pH 7.4, including about pH7.2, more effectively than its parent antibody that does not include a tag sequence in its Ig heavy chain constant region. In certain cases, the antibody conjugate exhibits binding to FcRn at physiological pH, e.g., about pH 7.2, that is about 1.1 fold or more, e.g., about 1.2 fold or more, about 1.5 fold or more, about 2 fold or more, about 3 fold or more, including about 5 fold or more compared to its parent antibody that does not include a tag sequence in its Ig heavy chain constant region. In certain cases, the antibody conjugate exhibits binding to FcRn at physiological pH, e.g., about pH 7.2, that is in the range of from about 1.1 fold to about 8 fold, e.g., from about 1.2 fold to about 7 fold, from about 1.5 fold to about 6 fold, including from about 2 fold to about 5 fold compared to its parent antibody that does not include a tag sequence in its Ig heavy chain constant region.

In certain embodiments, the antibody conjugate binds to one or more Fcγ receptors (e.g., FcRn) at an acidic pH and at a physiological pH, more effectively than its parent antibody that does not include a tag sequence in its Ig heavy chain constant region. In certain cases, the antibody conjugate exhibits binding to FcRn at an acidic pH, e.g., at about pH 5.5, that is about 1.1 fold or more, e.g., about 1.2 fold or more, about 1.5 fold or more, about 2 fold or more, about 3 fold or more, including about 5 fold or more compared to its parent antibody that does not include a tag sequence in its Ig heavy chain constant region, and exhibits binding to FcRn at a physiological pH, e.g., at about pH 7.2, that is about 1.1 fold or more, e.g., about 1.2 fold or more, about 1.5 fold or more, about 2 fold or more, about 3 fold or more, including about 5 fold or more compared to its parent antibody that does not include a tag sequence in its Ig heavy chain constant region. In certain cases, the antibody conjugate exhibits binding at an acidic pH, e.g., at about pH 5.5, to FcRn that is in the range of from about 1.1 fold to about 8 fold, e.g., from about 1.2 fold to about 7 fold, from about 1.5 fold to about 6 fold, including from about 2 fold to about 5 fold compared to its parent antibody that does not include a tag sequence in its Ig heavy chain constant region, and exhibits binding at a physiological pH, e.g., at about pH 7.2 to FcRn that is in the range of from about 1.1 fold to about 8 fold, e.g., from about 1.2 fold to about 7 fold, from about 1.5 fold to about 6 fold, including from about 2 fold to about 5 fold compared to its parent antibody that does not include a tag sequence in its Ig heavy chain constant region. Without being bound to theory, the presence of the payload conjugated to the Ig heavy chain constant region of the present antibody conjugate may alter the half-life of the antibody conjugate in the body when FcRn binding is modified both at acidic pH and at physiological pH, compared with the unconjugated antibody. For example, the present antibody conjugate may have reduced half-life in the body when FcRn binding is increased both at acidic pH and at physiological pH, compared with the unconjugated antibody. The shorter half-life may in turn reduce one or more systemic side effects that may be associated with administering (e.g., locally administering) the present antibody conjugate to an individual.

In certain embodiments, an antibody conjugate, and/or an fGly-modified but unconjugated antibody, that includes an Ig heavy chain constant region with a tag sequence positioned adjacent and N-terminal to an amino acid residue corresponding to position 227 or 247 of SEQ ID NO:1 exhibits enhanced binding to FcRn at acidic pH and at physiological pH, compared to its parent antibody that does not include a tag sequence in its Ig heavy chain constant region, as described above. In some embodiments, the tagged antibody includes a tagged Ig heavy chain polypeptide, where the tag contains an amino acid sequence of the formula $X^1Z^1X^2Z^2X^3Z^3$, where $X^1$, $X^2$, $X^3$, $Z^1$, $Z^2$ and $Z^3$ are as described above (in ", and where the Ig heavy chain polypeptide includes a constant region containing the amino acid sequence set forth in SEQ ID NO:310 or 326. In some embodiments, the tag contains the amino acid sequence LCTPSR (SEQ ID NO:561). In some embodiments, the tag of the fGly-modified antibody is a converted tag, where $Z^1$ is fGly. In some embodiments, the converted tag includes the amino acid sequence L(fGly)TPSR (SEQ ID NO:607). In some embodiments, the antibody conjugate includes a tagged Ig heavy chain polypeptide conjugated to a payload, where the tagged Ig heavy chain polypeptide includes the amino acid sequence set forth in SEQ ID NO:501 or 517. In some embodiments, the antibody conjugate includes, in the constant region of an Ig heavy chain polypeptide, a conjugated tag having the formula: L(fGly')TPSR (SEQ ID NO:630). In certain embodiments, the antibody includes a tagged Ig heavy chain polypeptide containing a constant region having the amino acid sequence set forth in SEQ ID NO:122 or 135.

Formulations

The antibody conjugates of the present disclosure can be formulated in a variety of different ways. In general, where the antibody conjugate is an antibody-drug conjugate, the antibody conjugate is formulated in a manner compatible with the drug conjugated to the Ig polypeptide (e.g., Ig heavy chain polypeptide), the condition to be treated, and the route of administration to be used.

The antibody conjugate (e.g., antibody-drug conjugate) can be provided in any suitable form, e.g., in the form of a pharmaceutically acceptable salt, and can be formulated for any suitable route of administration, e.g., oral, topical or parenteral administration. Where the antibody conjugate is provided as a liquid injectable (such as in those embodiments where they are administered intravenously or directly into a tissue), the antibody conjugate can be provided as a ready-to-use dosage form, or as a reconstitutable storagestable powder or liquid composed of pharmaceutically acceptable carriers and excipients.

Methods for formulating antibody conjugates can be adapted from those available in the art. For example, antibody conjugates can be provided in a pharmaceutical composition comprising an effective amount of an antibody conjugate and a pharmaceutically acceptable carrier (e.g., saline). The pharmaceutical composition may optionally include other additives (e.g., buffers, stabilizers, preservatives, and the like). Of particular interest in some embodiments are formulations that are suitable for administration to a mammal, particularly those that are suitable for administration to a human.

Nucleic Acids, Expression Vectors and Host Cells

The present disclosure provides a nucleic acid encoding Ig heavy chain polypeptides containing a tag, as well as constructs and host cells containing the nucleic acid. Such nucleic acids comprise a sequence of DNA having an open reading frame that encodes a tagged Ig heavy chain polypeptide and, in most embodiments, is capable, under appropriate conditions, of being expressed. "Nucleic acid" encompasses DNA, cDNA, mRNA, and vectors comprising such nucleic acids.

The present disclosure provides a recombinant nucleic acid comprising a nucleotide sequence encoding a tagged Ig heavy chain polypeptide, as described above. The recombinant nucleic acid can include:

1) a nucleotide sequence encoding a tagged Ig heavy chain constant region (and not an Ig heavy chain variable region, i.e., where the recombinant nucleic acid lacks a nucleotide sequence encoding an Ig $V_H$ domain);

2) a nucleotide sequence encoding a tagged Ig polypeptide, where the Ig polypeptide comprises an Ig $V_H$ domain and a tagged Ig heavy chain constant region;

3) a nucleotide sequence encoding an Ig light chain constant region (and not an Ig light chain variable region, i.e., where the recombinant nucleic acid lacks a nucleotide sequence encoding an Ig $V_L$ domain); and a nucleotide sequence encoding a tagged Ig heavy chain constant region (and not an Ig heavy chain variable region, i.e., where the recombinant nucleic acid lacks a nucleotide sequence encoding an Ig $V_H$ domain);

4) a nucleotide sequence encoding a tagged Ig heavy chain constant region, as described above, (and not an Ig heavy chain variable region, i.e., where the recombinant nucleic acid lacks a nucleotide sequence encoding an Ig $V_H$ domain); and a nucleotide sequence encoding a tagged Ig light chain constant region (and not an Ig light chain variable region, i.e., where the recombinant nucleic acid lacks a nucleotide sequence encoding an Ig $V_L$ domain);

5) a nucleotide sequence encoding a first tagged Ig polypeptide, where the first aldehyde-tagged Ig polypeptide comprises an Ig $V_H$ domain and a tagged Ig heavy chain constant region; and a nucleotide sequence encoding a second tagged Ig polypeptide, where the second tagged Ig polypeptide comprises an Ig $V_L$ domain and a tagged Ig light chain constant region;

6) a nucleotide sequence encoding a first Ig polypeptide, where the first Ig polypeptide comprises an Ig $V_H$ domain and an Ig heavy chain constant region; and a nucleotide sequence encoding a second Ig polypeptide, where the second Ig polypeptide includes a tag, where the second Ig polypeptide comprising an Ig $V_L$ domain and a tagged Ig light chain constant region.

A tagged Ig light chain polypeptide encoded by the nucleotide sequence described above may be any suitable tagged Ig light chain polypeptide. A suitable tagged Ig light chain polypeptides may include the sulfatase motif in the constant region, as described in, e.g., US20120183566 or U.S. application No. 62/327,906, filed on Apr. 26, 2016, the disclosures of which are incorporated herein by reference in their entirety.

The present disclosure provides a recombinant expression vector comprising a nucleic acid as described above, where the nucleotide sequence encoding the Ig polypeptide(s) is operably linked to a promoter. In some embodiments, where a subject recombinant expression vector encodes both Ig heavy and light chains (with or without Ig variable regions), the heavy and light chain-encoding sequences can be operably linked to the same promoter, or to separate promoters.

Where a recombinant expression vector includes a nucleotide sequence encoding a heavy chain variable ($V_H$) region and/or a light chain variable ($V_L$) region, it will be appreciated that a large number of $V_H$ and $V_L$ amino acid sequences, and nucleotide sequences encoding same, are known in the art, and can be used. See, e.g., Kabat et al., Sequences of Proteins of Immunological Interest, 5th Ed. Public Health Service, National Institutes of Health, Bethesda, Md. (1991).

In those instances in which a recombinant expression vector comprises a nucleotide sequence encoding an Ig heavy or Ig light chain without variable region sequences, the vector can include an insertion site for an Ig variable region 5' of the Ig polypeptide-encoding nucleotide sequence. For example, a recombinant expression vector can comprise, in order from 5' to 3':

1) an insertion site for a nucleotide sequence encoding a $V_L$ domain; and a nucleotide sequence encoding a Ig light chain constant region, which may or may not include tag; or 2) an insertion site for a nucleotide sequence encoding a $V_H$ domain; and a nucleotide sequence encoding a tagged Ig heavy chain constant region.

Nucleic acids contemplated herein can be provided as part of a vector (also referred to as a construct), a wide variety of which are known in the art. Exemplary vectors include, but are not limited to, plasmids; cosmids; viral vectors (e.g., retroviral vectors); non-viral vectors; artificial chromosomes (yeast artificial chromosomes (YAC's), BAC's, etc.); minichromosomes; and the like. The choice of vector will depend upon a variety of factors such as the type of cell in which propagation is desired and the purpose of propagation.

Vectors can provide for extrachromosomal maintenance in a host cell or can provide for integration into the host cell genome. Vectors are amply described in numerous publications well known to those in the art, including, e.g., Short Protocols in Molecular Biology, (1999) F. Ausubel, et al., eds., Wiley & Sons. Vectors may provide for expression of the nucleic acids encoding a polypeptide of interest (e.g., a tagged polypeptide, an FGE, etc.), may provide for propagating the subject nucleic acids, or both.

Exemplary vectors that may be used include but are not limited to those derived from recombinant bacteriophage DNA, plasmid DNA or cosmid DNA. For example, plasmid vectors such as pBR322, pUC 19/18, pUC 118, 119 and the M13 mp series of vectors may be used. Bacteriophage vectors may include λgt10, λgt11, λgt18-23, λZAP/R and the EMBL series of bacteriophage vectors. Cosmid vectors that may be utilized include, but are not limited to, pJB8, pCV 103, pCV 107, pCV 108, pTM, pMCS, pNNL, pHSG274, COS202, COS203, pWE15, pWE16 and the charomid 9 series of vectors. Alternatively, recombinant virus vectors may be engineered, including but not limited to those derived from viruses such as herpes virus, retroviruses, vaccinia virus, poxviruses, adenoviruses, adeno-associated viruses, or bovine papilloma virus.

For expression of a protein of interest (e.g., a tagged Ig polypeptide or an FGE), an expression cassette may be employed. Thus, the present invention provides a recombinant expression vector comprising a subject nucleic acid. The expression vector provides a transcriptional and translational regulatory sequence, and may provide for inducible or constitutive expression, where the coding region is operably linked under the transcriptional control of the transcriptional initiation region, and a transcriptional and translational termination region. These control regions may be native to the gene encoding the polypeptide (e.g., the Ig polypeptide or the FGE), or may be derived from exogenous sources. In general, the transcriptional and translational regulatory sequences may include, but are not limited to, promoter sequences, ribosomal binding sites, transcriptional start and stop sequences, translational start and stop sequences, and enhancer or activator sequences. In addition to constitutive and inducible promoters, strong promoters (e.g., T7, CMV, and the like) find use in the constructs described herein, particularly where high expression levels are desired in an in vivo (cell-based) or in an in vitro expression system. Further exemplary promoters include mouse mammary tumor virus (MMTV) promoters, Rous sarcoma virus (RSV) promoters, adenovirus promoters, the promoter from the immediate early gene of human CMV (Boshart et al., *Cell* 41:521-530, 1985), and the promoter from the long terminal repeat (LTR) of RSV (Gorman et al., *Proc. Natl. Acad. Sci. USA* 79:6777-6781, 1982). The promoter can also be provided by, for example, a 5'UTR of a retrovirus.

Expression vectors generally have convenient restriction sites located near the promoter sequence to provide for the insertion of nucleic acid sequences encoding proteins of interest. A selectable marker operative in the expression host may be present to facilitate selection of cells containing the vector. In addition, the expression construct may include additional elements. For example, the expression vector may have one or two replication systems, thus allowing it to be maintained in organisms, for example in mammalian or insect cells for expression and in a prokaryotic host for cloning and amplification. In addition the expression construct may contain a selectable marker gene to allow the selection of transformed host cells. Selection genes are well known in the art and will vary with the host cell used.

Expression constructs encoding tagged Ig polypeptides can also be generated using amplification methods (e.g., a polymerase chain reaction (PCR)), where at least one amplification primer (i.e., at least one of a forward or reverse primer) includes a nucleic acid sequence encoding an aldehyde tag. For example, an amplification primer having a tag amino acid sequence-encoding nucleotide sequence is designed to provide for amplification of a nucleic acid encoding an Ig polypeptide. The extension product that results from polymerase-mediated synthesis from the tagged forward primer produces a nucleic acid amplification product encoding a fusion protein composed of a tagged Ig polypeptide. The amplification product is then inserted into an expression construct of choice to provide a tagged polypeptide expression construct.

Host Cells

The present disclosure provides genetically modified host cells comprising a subject nucleic acid, including a genetically modified host cell comprising a recombinant expression vector as described above. Any of a number of suitable host cells can be used in the production of an antibody containing the present tagged Ig heavy chain polypeptide. The host cell used for production of an antibody containing the tagged Ig polypeptide can optionally provide for FGE-mediated conversion, so that the antibody produced contains an fGly-modified Ig polypeptide, where the tag is converted to contain fGly, following expression and modification by FGE. Alternatively the host cell can provide for production of an antibody containing a tagged and unconverted Ig heavy chain polypeptide (e.g., due to lack of expression of an FGE that facilitates conversion of the tag).

The aldehyde moiety of a converted tag can be used for a variety of applications including, but not limited to, visualization using fluorescence or epitope labeling (e.g., electron microscopy using gold particles equipped with aldehyde reactive groups); protein immobilization (e.g., protein microarray production); protein dynamics and localization studies and applications; and conjugation of proteins with a payload (e.g., moieties that improve a parent protein's half-life (e.g., poly(ethylene glycol)), targeting moieties (e.g., to enhance delivery to a site of action), and biologically active moieties (e.g., a therapeutic moiety).

In general, the polypeptides described herein may be expressed in prokaryotes or eukaryotes in accordance with conventional ways, depending upon the purpose for expression. Thus, the present invention further provides a host cell, e.g., a genetically modified host cell that comprises a nucleic acid encoding a tagged polypeptide. The host cell can further optionally comprise a recombinant FGE, which may be endogenous or heterologous to the host cell. Thus, in some cases, the host cell is genetically modified to express an FGE.

Host cells for production (including large scale production) of a tagged and unconverted, or (where the host cell expresses a suitable FGE) tagged and converted Ig polypeptide, or for production of an FGE (e.g., for use in a cell-free method) can be selected from any of a variety of available host cells. Exemplary host cells include those of a prokaryotic or eukaryotic unicellular organism, such as bacteria (e.g., *Escherichia coli* strains, *Bacillus* spp. (e.g., *B. subtilis*), and the like) yeast or fungi (e.g., *S. cerevisiae*, *Pichia* spp., and the like), and other such host cells can be used. Exemplary host cells originally derived from a higher organism such as insects, vertebrates, particularly mammals, (e.g. CHO, HEK, and the like), may be used as the expression host cells.

Suitable mammalian cell lines include, but are not limited to, HeLa cells (e.g., American Type Culture Collection (ATCC) No. CCL-2), CHO cells (e.g., ATCC Nos. CRL9618 and CRL9096), CHO DG44 cells (Urlaub (1983) *Cell* 33:405), CHO—K1 cells (ATCC CCL-61), 293 cells (e.g., ATCC No. CRL-1573), Vero cells, NIH 3T3 cells (e.g., ATCC No. CRL-1658), Huh-7 cells, BHK cells (e.g., ATCC No. CCL10), PC12 cells (ATCC No. CRL1721), COS cells, COS-7 cells (ATCC No. CRL1651), RAT1 cells, mouse L cells (ATCC No. CCLI.3), human embryonic kidney (HEK) cells (ATCC No. CRL1573), HLHepG2 cells, and the like.

Specific expression systems of interest include bacterial, yeast, insect cell and mammalian cell derived expression systems. Representative systems from each of these categories are provided below.

The product can be recovered by any appropriate means known in the art. Further, any convenient protein purification procedures may be employed, where suitable protein purification methodologies are described in Guide to Protein Purification, (Deuthser ed.) (Academic Press, 1990). For example, a lysate may prepared from a cell comprising the expression vector expressing the tagged Ig polypeptide, and purified using high performance liquid chromatography (HPLC), exclusion chromatography, gel electrophoresis, affinity chromatography, and the like.

Methods

Methods for Conversion and Modification of a Tag

Conversion of a tag, e.g., a sulfatase motif in a tag, present in a tagged Ig polypeptide of an antibody can be accomplished by cell-based (in vivo) or cell-free methods (in vitro). Similarly, modification of a converted tag of a tagged polypeptide can be accomplished by cell-based (in vivo) or cell-free methods (in vitro). These are described in more detail below.

"In Vivo" Host Cells Conversion and Modification

Conversion of a tag, e.g., a sulfatase motif in a tag, of an aldehyde tagged polypeptide of an antibody can be accomplished by expression of the tagged polypeptide in a cell that contains a suitable FGE. In this embodiment, conversion of the cysteine or serine of the tag occurs during or following translation in the host cell. The FGE of the host cell can be endogenous to the host cell, or the host cell can be recombinant for a suitable FGE that is heterologous to the host cell. FGE expression can be provided by an expression system endogenous to the FGE gene (e.g., expression is provided by a promoter and other control elements present in the native FGE gene of the host cell), or can be provided by from a recombinant expression system in which the FGE coding sequence is operably linked to a heterologous promoter to provide for constitutive or inducible expression.

Conditions suitable for use to accomplish conjugation of a reactive partner moiety to a tagged polypeptide are similar to those described in Mahal et al. (1997 May 16) Science 276(5315):1125-8.

In some instances, where the present method is carried out in a cell, the cell is in vitro, e.g., in in vitro cell culture, e.g., where the cell is cultured in vitro in a single-cell suspension or as an adherent cell. In some embodiments, the cell is cultured in the presence of an oxidation reagent that can activate FGE. In some embodiments, a cell expressing an FGE is cultured in the presence of a suitable amount of $Cu^{2+}$ in the culture medium. In certain aspects, the $Cu^{2+}$ is present in the cell culture medium at a concentration of from 1 nM to 100 mM, such as from 0.1 µM to 10 mM, from 1 µM to 1 mM, from 2 µM to 500 µM, from 4 µM to 300 µM, or from 5 µM to 200 µM (e.g., from 10 µM to 150 µM). The culture medium may be supplemented with any suitable copper salt to provide for the $Cu^{2+}$. Suitable copper salts include, but are not limited to, copper sulfate (i.e., copper(II) sulfate, $CuSO_4$), copper citrate, copper tartrate, copper nitrate, and any combination thereof.

"In Vitro" (Cell-Free) Conversion and Modification

In vitro (cell-free) conversion of a tag, e.g., a sulfatase motif in a tag, of a tagged Ig polypeptide of an antibody can be accomplished by contacting a tagged polypeptide with an FGE under conditions suitable for conversion of a cysteine or serine of a sulfatase motif of the tag to an fGly. For example, nucleic acid encoding a tagged Ig polypeptide can be expressed in an in vitro transcription/translation system in the presence of a suitable FGE to provide for production of tagged and converted Ig polypeptides.

Alternatively, isolated, unconverted, tagged Ig polypeptide can be isolated following recombinant production in a host cell lacking a suitable FGE or by synthetic production. The isolated tagged Ig polypeptide is then contacted with a suitable FGE under conditions to provide for tag conversion. The tagged Ig polypeptide can be unfolded by methods known in the art (e.g., using heat, adjustment of pH, chaotropic agents, (e.g., urea, and the like), organic solvents (e.g., hydrocarbons: octane, benzene, chloroform), etc.) and the denatured protein contacted with a suitable FGE. The tagged Ig polypeptide can then be refolded under suitable conditions.

With respect to modification of tagged and converted Ig polypeptide of an antibody, e.g., to covalently and site-specifically attach a payload (e.g., drug) thereto, modification is normally carried out in vitro. An antibody containing a converted aldehyde tagged Ig polypeptide is isolated from a production source (e.g., recombinant host cell production, synthetic production), and contacted with a reactive partner-containing drug or other moiety under conditions suitable to provide for conjugation of the drug or other moiety to the fGly of the tag in the Ig polypeptide, e.g., Ig heavy chain polypeptide, of the antibody.

In some instances, a combination of cell-based conversion and cell-free conversion is carried out, to generate a converted tag; followed by cell-free modification of the converted tag. In some embodiments, a combination of cell-free conversion and cell-based conversion is carried out.

Method of Producing an Antibody Conjugate

Aspects of the present disclosure include a method of producing an antibody conjugate, as described herein. In general terms, the method may include combining, in a reaction mixture, an fGly-modified antibody having a converted tag in its Ig heavy chain polypeptide, as described above, and a reactive partner, e.g., an aldehyde-reactive reactive partner, that includes the payload (e.g., drug) and an aldehyde-reactive group. In some cases, the reactive partner may be represented by the formula: P-(L)-R, where P is the payload covalently linked to R, an aldehyde-reactive group, through an optional linking group L. Under suitable conditions, the aldehyde-reactive group may react with the aldehyde group of the fGly in the converted tag of the fGly-modified antibody ("A") in the reaction mixture, to form a covalent linkage between the payload (e.g., drug) and the fGly-modified antibody at the fGly residue of the converted tag (which may be represented by the formula: P-(L)-A, or P-(L)-A-(L)-P, etc., depending on the number of tags present in each of the Ig polypeptides of the antibody). The reaction may be carried out in any suitable condition, such as those described in, e.g., US20120183566, US20140141025 and WO2014074218, each of which is incorporated herein by reference.

The payload (P) may be any suitable moiety (e.g., drug, water-soluble polymer, detectable label, synthetic peptide, etc.) as described above, and may be a compound that can be functionalized with an aldehyde-reactive group. The aldehyde-reactive group (R) may be any suitable functional group suitable for carrying out a conjugation reaction between the present fGly-modified antibody and the reactive partner. In some cases, the aldehyde-reactive group is an α-nucleophile, such as an aminooxy or hydrazide group. Suitable aldehyde-reactive groups include, without limitation, a hydrazine compound, hydrazide compound, aminooxy compound, semicarbazide (e.g., thiosemicarbazide) compound, hydrazinyl-indole compound, hydrazinyl-imidazole compound, hydrazinyl-pyrrole compound, hydrazinyl-furan compound, and a pyrazalinone compound.

In some embodiments, the reactive partner includes a payload (P) (e.g., drug) attached to an aldehyde-reactive group (R) that is based on a hydrazinyl-indole group, and can be produced using any suitable method, e.g., as described in US20140141025, which is incorporated herein by reference. A hydrazinyl-indole-containing reactive partner may react with an aldehyde of fGly in a converted tag in an fGly-modified antibody, as described herein, where the hydrazine of the hydrazinyl-indole coupling moiety undergoes an intramolecular cyclization to form a partially unsaturated pyrazole or pyridazine ring, to covalently attach the payload (e.g., drug) to the antibody Ig heavy chain polypeptide. Alternatively, the hydrazine of the hydrazinyl-indole coupling moiety may undergo an intramolecular cyclization to form a partially unsaturated pyridazine or 1,2-diazepine ring, to covalently attach the payload (e.g., drug) to the antibody Ig heavy chain polypeptide.

In some cases, the reactive partner includes a payload (P) (e.g., drug) attached to an aldehyde-reactive group (R) based on a pyrazalinone group, and can be produced using any suitable method, e.g., as described in WO2014074218, which is incorporated herein by reference. A pyrazalinone-containing reactive partner may react with an aldehyde of fGly in a converted tag in an fGly-modified antibody, as described herein, to covalently attach the payload (e.g., drug) of the reactive partner to the antibody Ig heavy chain polypeptide through a cyclic linkage.

In some cases, the reactive partner includes a payload (P) (e.g., drug) attached to an aldehyde-reactive group (R) based on a hydrazinyl-substituted heteroaryl ring compound, such as a hydrazinyl-substituted 5-membered heteroaryl ring compound, where one or more atoms in the ring is a heteroatom (e.g., N, O or S). The hydrazinyl-substituted heteroaryl ring compound may include a hydrazinyl-imidazole compound, hydrazinyl-pyrrole compound, or a hydrazinyl-furan compound. Thus, a hydrazinyl-substituted heteroaryl ring compound (e.g., a hydrazinyl-imidazole compound, hydrazinyl-pyrrole compound, a hydrazinyl-furan compound) may react with an aldehyde of fGly in a converted tag in an fGly-modified antibody, as described herein, to covalently attach the payload (e.g., drug) to the antibody Ig heavy chain polypeptide through a cyclic linkage.

The reactive partner may further include a linking group (L) bridging the payload (P) (e.g., drug) and the aldehyde-reactive group (R) through covalent bonds. The linking group may be any suitable linking group. In some cases, the linking group includes polyethylene glycol (PEG); amino acids; alkyl groups, including substituted alkyl groups; a protease cleavable group; esters; acyloxy groups, including substituted acyloxy groups, etc. Suitable linking groups and methods of using the same to bridge a payload (e.g., drug) and an aldehyde-reactive group are described in, e.g., US20150157736, which is incorporated by reference herein. In some embodiments, the linking group includes a 4-aminopiperidine (4AP) derivative.

In some cases, the payload is a drug, e.g., a peptide drug. In some cases, peptide drugs to be conjugated to a tagged and converted Ig polypeptide of an fGly-modified antibody can be modified to incorporate an aldehyde-reactive group for reaction with an aldehyde of the fGly residue of the tagged and converted Ig polypeptide. Since the methods of tagged and converted polypeptide modification are compatible with conventional chemical processes, any of a wide variety of commercially available reagents can be used to accomplish conjugation. For example, aminooxy, hydrazide, hydrazine, thiosemicarbazide, hydrazinyl-indole, hydrazinyl-imidazole, hydrazinyl-pyrrole, hydrazinyl-furan or pyrazalinone derivatives of a number of moieties of interest are suitable reactive partners, and are readily available or can be generated using standard chemical methods.

Where the drug is a peptide drug, the reactive moiety (e.g., aminooxy or hydrazide can be positioned at an N-terminal region, the N-terminus, a C-terminal region, the C-terminus, or at a position internal to the peptide. For example, one method involves synthesizing a peptide drug having an aminooxy group. In this example, the peptide is synthesized from a Boc-protected precursor. An amino group of a peptide can react with a compound comprising a carboxylic acid group and oxy-N-Boc group. As an example, the amino group of the peptide reacts with 3-(2,5-dioxopyrrolidin-1-yloxy)propanoic acid. Other variations on the compound comprising a carboxylic acid group and oxy-N-protecting group can include different number of carbons in the alkylene linker and substituents on the alkylene linker. The reaction between the amino group of the peptide and the compound comprising a carboxylic acid group and oxy-N-protecting group occurs through standard peptide coupling chemistry. Examples of peptide coupling reagents that can be used include, but not limited to, DCC (dicyclohexylcarbodiimide), DIC (diisopropylcarbodiimide), di-p-toluoyl-carbodiimide, BDP (1-benzotriazole diethylphosphate-1-cyclohexyl-3-(2-morpholinylethyl)carbodiimide), EDC (1-(3-dimethylaminopropyl-3-ethyl-carbodiimide hydrochloride), cyanuric fluoride, cyanuric chloride, TFFH (tetramethyl fluoroformamidinium hexafluorophosphphate), DPPA (diphenylphosphorazidate), BOP (benzotriazol-1-yloxytris(dimethylamino)phosphonium hexafluorophosphate), HBTU (O-benzotriazol-1-yl-N,N,N',N'-tetramethyluronium hexafluorophosphate), TBTU (O-benzotriazol-1-yl-N,N,N',N'-tetramethyluronium tetrafluoroborate), TSTU (O—(N-succinimidyl)-N,N,N',N'-tetramethyluronium tetrafluoroborate), HATU (N-[(dimethylamino)-1-H-1,2,3-triazolo[4,5,6]-pyridin-1-ylmethylene]N-methylmethanaminium hexafluorophosphate N-oxide), BOP—Cl (bis(2-oxo-3-oxazolidinyl)phosphinic chloride), PyB OP ((1-H-1,2,3-benzotriazol-1-yloxy)-tris(pyrrolidino)phosphonium tetrafluorophopsphate), BrOP (bromotris(dimethylamino) phosphonium hexafluorophosphate), DEPBT (3-(diethoxyphosphoryloxy)-1,2,3-benzotriazin-4(3H)-one) PyBrOP (bromotris(pyrrolidino)phosphonium hexafluorophosphate). As a non-limiting example, HOBt and DIC can be used as peptide coupling reagents.

Deprotection to expose the amino-oxy functionality is performed on the peptide comprising an N-protecting group. Deprotection of the N-oxysuccinimide group, for example, occurs according to standard deprotection conditions for a cyclic amide group. Deprotecting conditions can be found in Greene and Wuts, Protective Groups in Organic Chemistry, 3rd Ed., 1999, John Wiley & Sons, NY and Harrison et al. Certain deprotection conditions include a hydrazine reagent, amino reagent, or sodium borohydride. Deprotection of a Boc protecting group can occur with TFA. Other reagents for deprotection include, but are not limited to, hydrazine, methylhydrazine, phenylhydrazine, sodium borohydride, and methylamine. The product and intermediates can be purified by conventional means, such as HPLC purification.

The ordinarily skilled artisan will appreciate that factors such as pH and steric hindrance (i.e., the accessibility of the aldehyde tag to reaction with a reactive partner of interest) are of importance. Modifying reaction conditions to provide for optimal conjugation conditions is well within the skill of the ordinary artisan, and is routine in the art. In general, it is normally desirable to conduct conjugation reactions at a pH below 7, with a pH of about 5.5, about 6, about 6.5, usually about 5.5 being optimal. Where conjugation is conducted with a tagged and converted polypeptide present in or on a living cell, the conditions are selected so as to be physiologically compatible. For example, the pH can be dropped temporarily for a time sufficient to allow for the reaction to occur but within a period tolerated by the cell having an aldehyde tag (e.g., from about 30 min to 1 hour).

Physiological conditions for conducting modification of tagged and converted polypeptides on a cell surface can be similar to those used in a ketone-azide reaction in modification of cells bearing cell-surface azides (see, e.g., U.S. Pat. No. 6,570,040).

Small molecule compounds containing, or modified to contain, an α-nucleophilic group that serves as a reactive partner with an aldehyde of an fGly of a converted tag are also contemplated for use as drugs in the Ig-drug conjugates of the present disclosure. General methods are known in the art for chemical synthetic schemes and conditions useful for synthesizing a compound of interest (see, e.g., Smith and March, March's Advanced Organic Chemistry: Reactions, Mechanisms, and Structure, Fifth Edition, Wiley-Interscience, 2001; or Vogel, A Textbook of Practical Organic Chemistry, Including Qualitative Organic Analysis, Fourth Edition, New York: Longman, 1978).

Thus small molecules having an aminooxy or hydrazone group for reaction with an aldehyde of an fGly of a tagged and converted Ig polypeptide are available or can be readily synthesized. An aminooxy or hydrazone group can be installed onto a small molecule using standard synthetic chemistry techniques.

Method of Treating an Individual

The antibody-drug conjugates of the present disclosure find use in treatment of a condition or disease in a subject that is amenable to treatment by administration of the parent drug (i.e., the drug prior to conjugation to the antibody). By "treatment" is meant that at least an amelioration of the symptoms associated with the condition afflicting the host is achieved, where amelioration is used in a broad sense to refer to at least a reduction in the magnitude of a parameter, e.g. symptom, associated with the condition being treated. As such, treatment also includes situations where the pathological condition, or at least symptoms associated therewith, are completely inhibited, e.g., prevented from happening, or stopped, e.g. terminated, such that the host no longer suffers from the condition, or at least the symptoms that characterize the condition. Thus treatment includes: (i) prevention, that is, reducing the risk of development of clinical symptoms, including causing the clinical symptoms not to develop, e.g., preventing disease progression to a harmful state; (ii) inhibition, that is, arresting the development or further development of clinical symptoms, e.g., mitigating or completely inhibiting an active disease; and/or (iii) relief, that is, causing the regression of clinical symptoms.

In the context of cancer, the term "treating" includes any or all of: reducing growth of a solid tumor, inhibiting replication of cancer cells, reducing overall tumor burden, and ameliorating one or more symptoms associated with a cancer. Thus, the present disclosure provides methods for delivering a cancer chemotherapeutic agent to an individual having a cancer. The methods are useful for treating a wide variety of cancers, including carcinomas, sarcomas, leukemias, and lymphomas. The cancer treated by the present method may be a cancer of a variety of tissues organs, such as, without limitation, cancer of the lungs, liver, breast, prostate, ovary, kidney, brain, colon, intestine, spleen, stomach, mouth, throat, skin, blood cells, etc.

The antibody to which the payload, e.g., drug, such as a cancer chemotherapeutic agent, is bound may specifically bind to an antigen associated with cell(s) or tissue(s) that are to be targeted and acted upon by the payload.

The present method may include administering to an individual a therapeutically effective amount of an antibody conjugate, e.g., an antibody-drug conjugate, as described herein. The antibody conjugate may be in any suitable formulation, e.g., formulated with a pharmaceutically acceptable excipient, as described herein.

The subject to be treated can be one that is in need of therapy, where the host to be treated is one amenable to treatment using the parent drug. Accordingly, a variety of subjects may be amenable to treatment using an antibody-drug conjugates disclosed herein. Generally such subjects are "mammals", with humans being of particular interest. Other subjects can include domestic pets (e.g., dogs and cats), livestock (e.g., cows, pigs, goats, horses, and the like), rodents (e.g., mice, guinea pigs, and rats, e.g., as in animal models of disease), as well as non-human primates (e.g., chimpanzees, and monkeys).

The amount of antibody-drug conjugate administered can be initially determined based on guidance of a dose and/or dosage regimen of the parent drug. In general, the antibody-drug conjugates can provide for targeted delivery and/or enhanced serum half-life of the bound drug, thus providing for at least one of reduced dose or reduced administrations in a dosage regimen. Thus the antibody-drug conjugates can provide for reduced dose and/or reduced administration in a dosage regimen relative to the parent drug prior to being conjugated in an Ig-drug conjugate of the present disclosure.

Furthermore, as noted above, because the antibody-drug conjugates can provide for controlled stoichiometry of drug delivery, dosages of antibody-drug conjugates can be calculated based on the number of drug molecules provided on a per antibody-drug conjugate basis.

In some embodiments, multiple doses of an antibody-drug conjugate are administered. The frequency of administration of an antibody-drug conjugate can vary depending on any of a variety of factors, e.g., severity of the symptoms, etc. For example, in some embodiments, an Ig-drug conjugate is administered once per month, twice per month, three times per month, every other week (qow), once per week (qw), twice per week (biw), three times per week (tiw), four times per week, five times per week, six times per week, every other day (qod), daily (qd), twice a day (qid), or three times a day (tid).

EXAMPLES

The following examples are put forth so as to provide those of ordinary skill in the art with a complete disclosure and description of how to make and use the disclosed subject matter, and are not intended to limit the scope of what the inventors regard as their invention nor are they intended to represent that the experiments below are all or the only experiments performed. Efforts have been made to ensure accuracy with respect to numbers used (e.g. amounts, temperature, etc.) but some experimental errors and deviations should be accounted for. Unless indicated otherwise, parts are parts by weight, molecular weight is weight average molecular weight, temperature is in degrees Celsius, and pressure is at or near atmospheric. Standard abbreviations may be used, e.g., bp, base pair(s); kb, kilobase(s); pl, picoliter(s); s or sec, second(s); min, minute(s); h or hr, hour(s); aa, amino acid(s); kb, kilobase(s); bp, base pair(s); nt, nucleotide(s); i.m., intramuscular(ly); i.p., intraperitoneal (ly); s.c., subcutaneous(ly); and the like.

Example 1

Production of Tagged Ig Heavy Chain Constructs and Antibodies Containing Tagged Heavy Chains Positions within the constant region of human IgG1 heavy chain were systematically scanned by a tag insertion. A collection of tagged heavy chain constructs were generated by inserting the tag sequence: LCTPSR (SEQ ID NO:561) between adjacent amino acids at different sites in the heavy chain constant region. Each construct also contained a heavy chain variable region of an antibody specific for a cell surface antigen ("antibody A"). The entire length of the heavy chain constant region was scanned, to generate 330 variants, each having the tag inserted at a different position. Each heavy chain variant was provided in an expression vector for expression in Chinese hamster ovary (CHO) cells.

Methods and Materials

Figure 19:
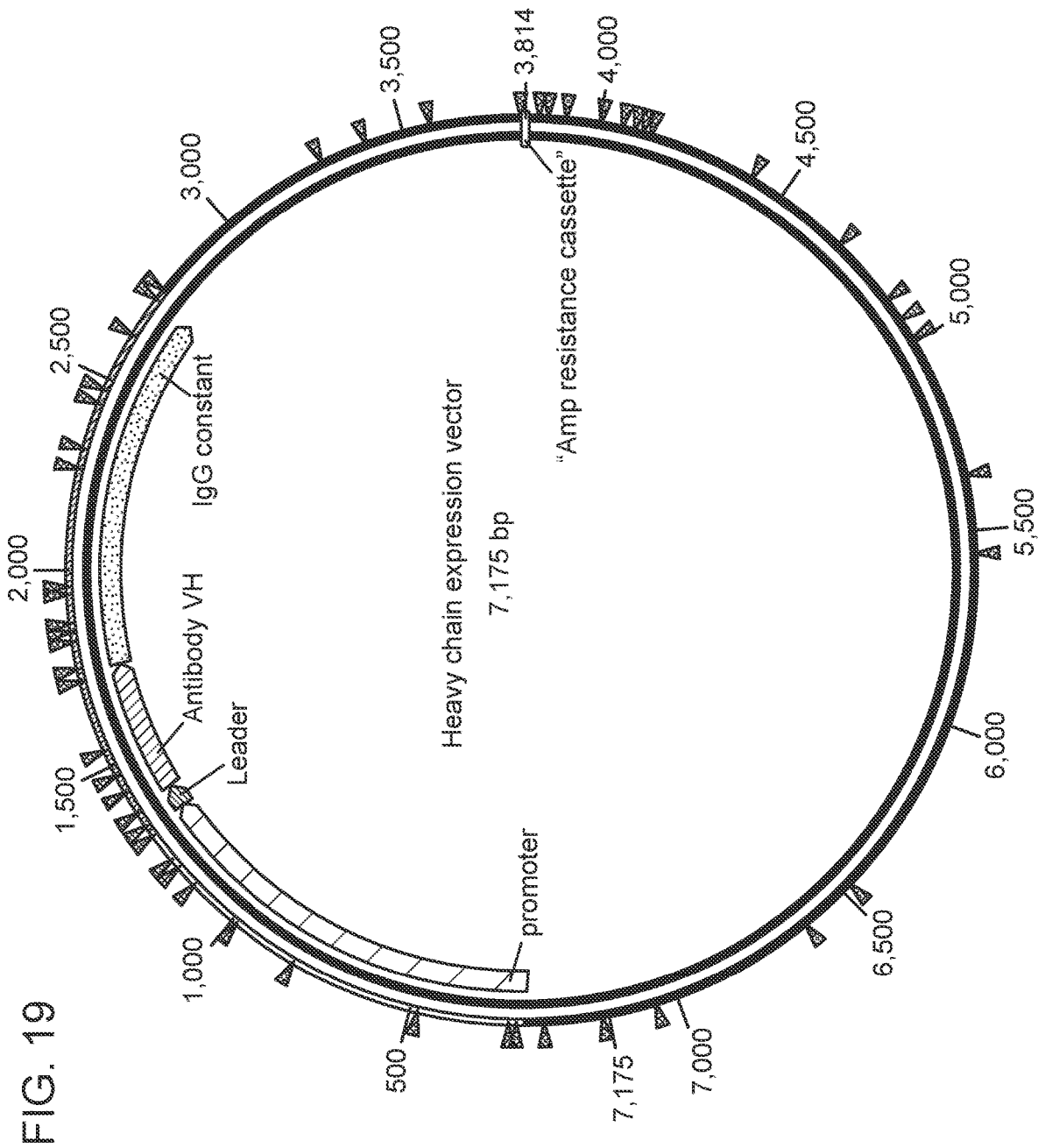
FIG. 19 shows a vector map of an expression vector encoding an Ig heavy chain polypeptide of an antigen-specific antibody, according to embodiments of the present disclosure.

Heavy chain expression vector for the antigen-specific antibody was generated and digested with KpnI and DraIII in order to remove wild type human heavy chain constant region (FIG. 19). The digested plasmid DNA was purified by gel electrophoresis and QIAquick gel extraction kit (Qiagen, MD). The purified plasmid backbone was used for cloning variant human gamma 1 heavy chain constant genes containing aldehyde tag site in various positions.

Figure 21A:
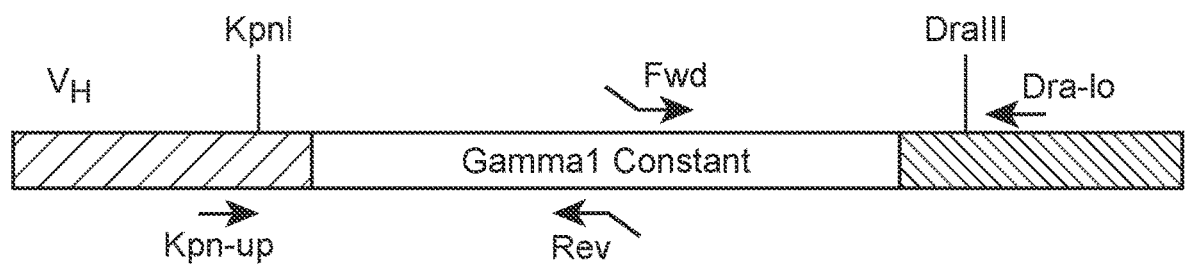
FIGS. 21A and 21B are a collection of schematic diagrams showing the annealing sites of PCR primers and assembly strategy of DNA fragments, according to embodiments of the present disclosure.
Figure 21B:
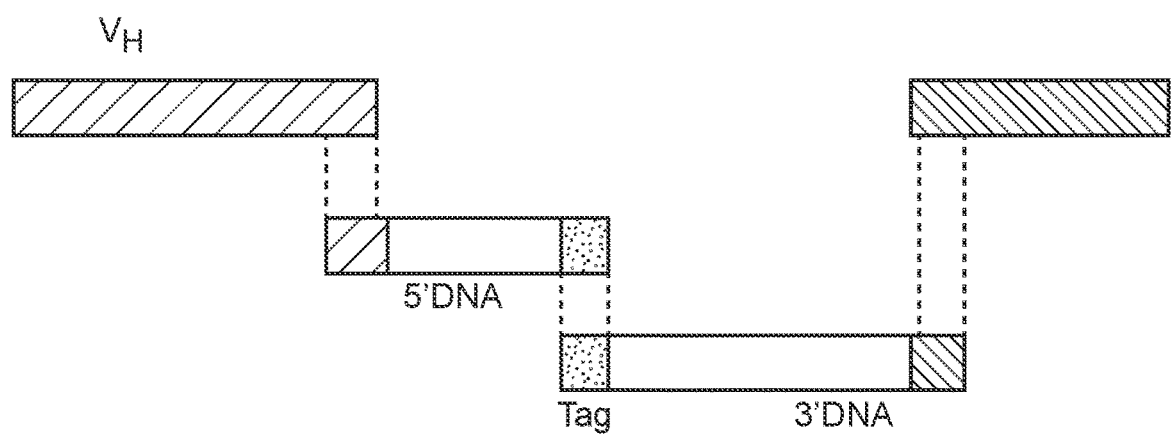

For inserting an aldehyde tag site into human heavy chain constant region, two PCR amplifications were performed using the heavy chain expression vector as a template with Phusion DNA polymerase (New England Biolabs, MA). PCR condition was preheat 98° C. for 1 min and 30 cycle of 98° C. for 10 seconds, 60° C. for 10 seconds, 72° C. for 20 seconds followed by 72° C. for 1 min for final extension. PCR amplification for the 5' part of human gamma 1 heavy chain constant region was performed using a reverse primer (FIG. 21A) with Kpn-up (5' GGGTCGCATACATTAGTAGTGGTGGTG 3' (SEQ ID NO:654)) and the 3' part of the DNA fragments were amplified using a forward primer and Dra-lo (5' AAAACCGTCTATCAGGGCGATGGCCCA 3' (SEQ ID NO:655)) (FIG. 21A). All pairs of forward and reverse primers were designed to insert a tag sequence, LCTPSR (SEQ ID NO:561), throughout the human gamma 1 heavy chain constant region. The amplified 5' DNA fragment and the corresponding 3' DNA fragment have compatible overlaps for assembly as shown in the FIG. 21B. The amplified 5' and 3' DNA fragments were combined resulting in total 331 pairs of DNA mixture. Linearized pRW1064 using KpnI and DraIII was added to the DNA mixtures and the reaction was subjected to Gibson assembly using Gibson assembly master mix (New England Biolabs, MA) according to the manufacturer's protocol.

The assembled DNA was transformed into *E. coli* Top10 chemically competent cells (Thermo Fisher Scientific) by the heat shock method (Sambrook and Russell 2001). For this purpose 3 μl of the assembled plasmid DNA was added to 50 μl of chemically competent *E. coli* Top10 and the mixture was incubated on ice for 30 minutes and then subjected to a heat shock at 42° C. for 45 seconds. Then, the suspension was immediately placed on ice for one minute and 500 μl of SOC medium (Teknova, CA) was added. This mixture was incubated for 1 hour at 37° C. on shaker. These cells were plated on LB agar media (Teknova, CA) with antibiotic carbenicillin (100 μg/ml) as selection marker and grown overnight at 37° C. incubator. Colonies appeared on the agar plate were individually picked and inoculated into 3 ml of LB broth and grown at 37° C. for overnight followed by plasmid DNA purification using plasmid DNA isolation kit (Qiagen, Germany) according to the manufacturer's protocol. Total 331 clones' DNA sequence integrity was confirmed by sending out to a sequencing service vendor (Sequetech, CA).

Example 2

Analysis of Expression Titer of Antibodies with a Tag in the Heavy Chain

Figure 20:
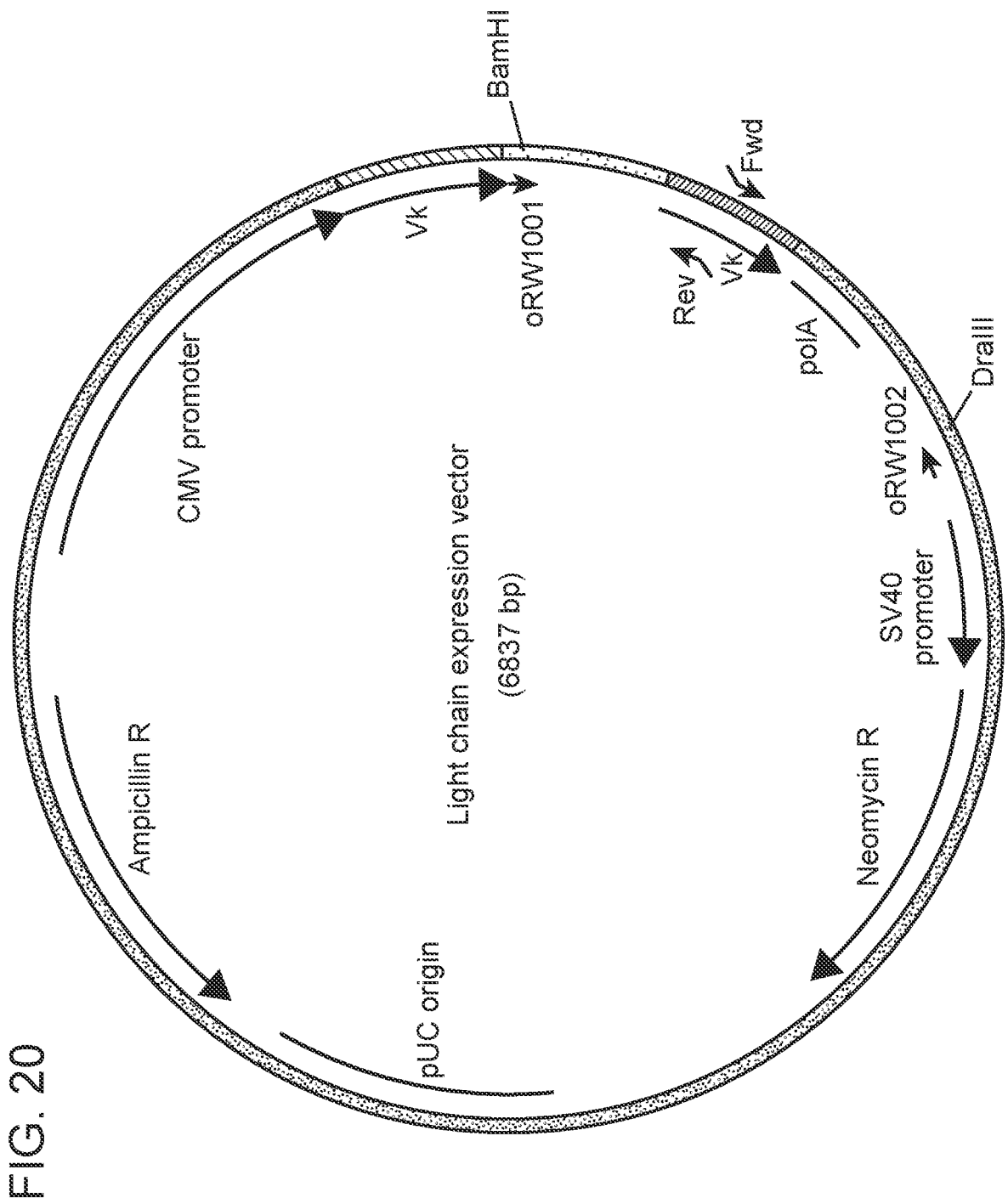
FIG. 20 shows a vector map for an expression vector encoding an Ig light chain polypeptide of an antigen-specific antibody.

The effect of inserting a tag at different positions along the heavy chain on the titer of expression of antibody A was tested by transfecting CHO cells (ExpiCHO™ cells) with an expression vector containing each of the variant heavy chains generated as described in Example 1, together with a second expression vector encoding the light chain polypeptide of the antigen-specific antibody (FIG. 20), and a third expression vector encoding a formylglycine generating enzyme (FGE). Then the amount of antibodies secreted into the culture medium by cells expressing antibodies having the tag inserted along different positions of the heavy chain constant region was measured. The measured antibody titer showed that insertion position affected efficiency of expression from the CHO cells (FIGS. 1A, 1B, 4A, 4B, 7A and 7B).

FIGS. 1A, 1B, 4A, 4B, 7A, and 7B: The expression titer (y-axis), in ExpiCHO™ cells, of variant tagged antibody A, each having a sulfatase motif inserted adjacent and N-terminal to the position indicated, as defined relative to SEQ ID NO:1, in the constant region of its Ig heavy chain amino acid sequence.

Materials and Methods

Expi-CHO—S cells were maintained routinely in 150 ml shaking flask in CHO expression medium (Thermo Fisher Scientific) at 37° C., and 8% $CO_2$. One day before transfection Expi-CHO-S cells were seeded into fresh CHO expression medium with the final cell density of $4 \times 10^6$ cells/ml. On next day, the cell number in the suspension culture was determined by using TC20 cell counter (Bio-Rad, CA) and adjusted the cell density to $6 \times 10^6$/ml by adding additional CHO expression medium. At this step, 100 mM of $CuSo_4$ was supplemented to a final concentration of 100 uM. 6 ml of cells were seeded in a disposable mini-bioreactor tube (Corning, NY) for transfection. 2.7 ug of the expression vector for light chain (FIG. 20) and 1.5 ug of FGE expression plasmid DNA were mixed with 1.8 ug of the heavy chain expression vector in 240 ul of Opti-SFM (Thermo Fisher Scientific, CA) followed by combining with lipofectamine mixture containing 19.2 ul of Expi-Cho-Fectamine in 240 ul of Opti-SFM.

The Expi—CHO Fectamine and DNA complex was directly added to the cells and briefly mixed by swirling. After culturing at 37° C., and 8% $CO_2$ with 180 rpm orbital shaking for a day, 36 ul of enhancer solution and 960 ul of feed provided in the Expi-CHO transfection kit (Thermo Fisher Scientific, CA) was added to the cell and the cells were kept at 32° C. and 5% $CO_2$ with 180 rpm orbital agitation. After 4 days, additional 960 ul of feed was added to the cell and the cells were kept in the same culture condition for 5 days more. The culture supernatant was harvested by centrifugation and filtration with 0.45 um PES filter followed by IgG quantification with Blitz system (Forte Bio, CA) using protein A biosensor chips.

Example 3

Analysis of Aggregation of Antibodies with a Tag in the Heavy Chain

The effect of inserting a tag at different positions along the heavy chain on aggregation of tagged antibody A, each having a sulfatase motif inserted adjacent and N-terminal to the position indicated, as defined relative to SEQ ID NO:1, in the constant region of its Ig heavy chain amino acid sequence, was tested. The results of the aggregation test are shown as % of antibody monomer (FIGS. 2A, 2B, 5A, 5B, 8A, and 8B). To determine aggregation, samples were analyzed using analytical size exclusion chromatography (SEC; Tosoh #08541) with a mobile phase of 300 mM NaCl, 25 mM sodium phosphate pH 6.8.

Example 4

Analysis of Conjugation Efficiency of Antibodies with a Tag in the Heavy Chain

A subset of insertion sites selected based on the titer, as shown in Example 2, and aggregation property, as shown in Example 3, was chosen to study the conjugation efficiency, as measured by the drug-to-antibody ratio (DAR). Antibodies having a tagged (fGly-containing) heavy chain polypeptide were conjugated with a hydrophobic payload, a detectable label which serves as a surrogate for drug. Measurement of DAR of the tagged antibody A after conjugation with the hydrophobic payload showed variable conjugation efficiency across the different insertion sites (FIGS. 3A, 3B, 6A, 6B, 9A, and 9B).

Functional properties of tagged antibodies and antibody conjugates based on antibodies with different binding specificity are summarized in Table 5 in FIG. 11 (antibody A), and Table 6 in FIG. 12 (antibody B, binding antigen that is distinct from that bound by antibody A). Table headings: "Expression"—expression titer; "mAB % monomer"—% antibody monomer of tagged but unconjugated antibody; "ADC % monomer"—% antibody monomer of antibody conjugate.

Materials and Methods

To determine the drug-to-antibody ratio (DAR) of the final product, antibody-drug conjugates (ADCs) were examined by analytical HIC (Tosoh #14947) with mobile phase A: 1.5 M ammonium sulfate, 25 mM sodium phosphate pH 7.0, and mobile phase B: 25% isopropanol, 18.75 mM sodium phosphate pH 7.0.

Example 5

Fc Receptor Binding by Antibody-Drug Conjugates

Figure 10:
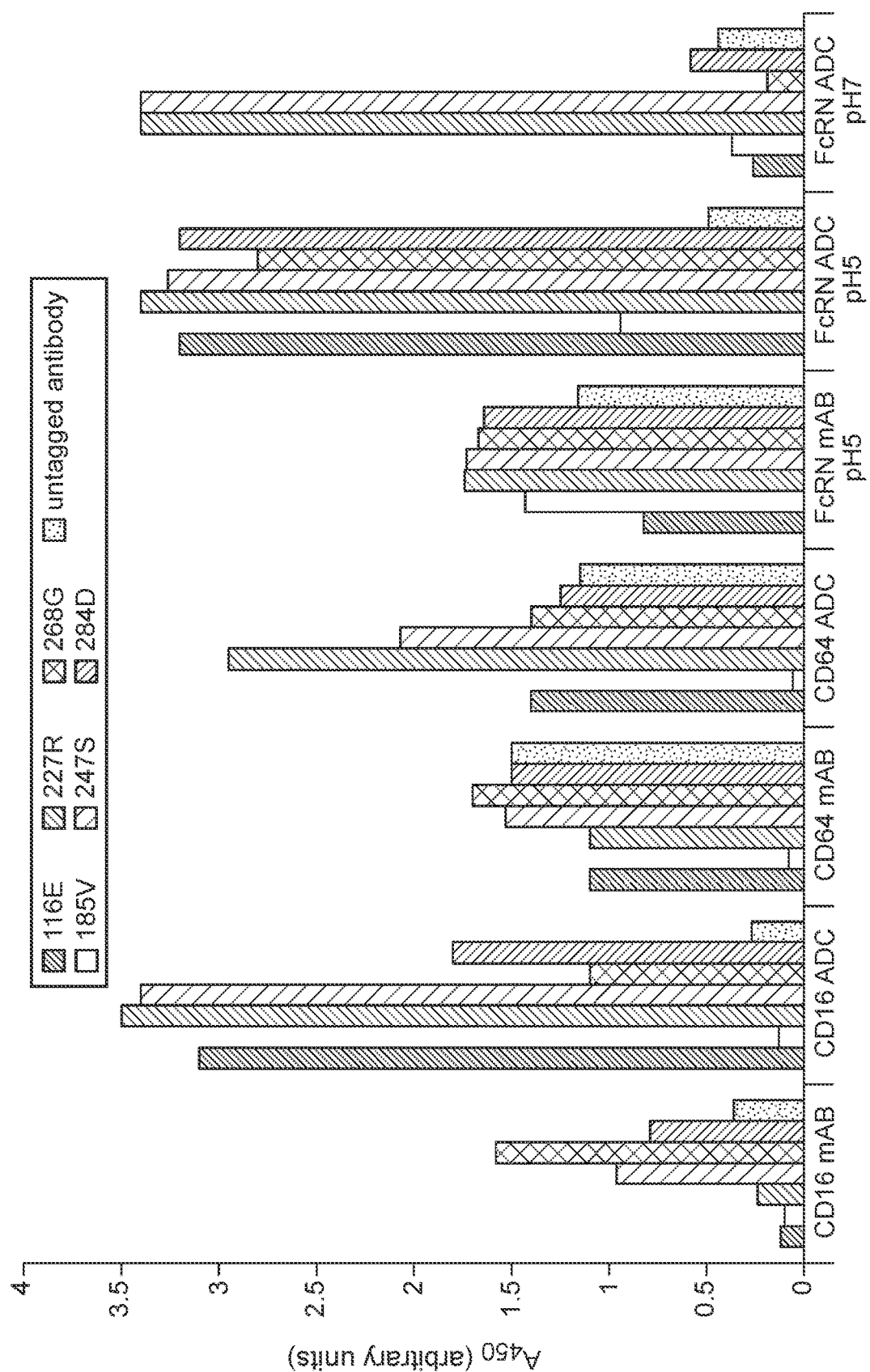
FIG. 10 shows binding of tagged but unconjugated antibodies or antibody conjugates, where the tag is inserted adjacent and N-terminal to the indicated positions, as defined relative to SEQ ID NO:1, and Fc receptors, according to embodiments of the present disclosure.

Select insertion sites, as indicated in FIG. 10, were chosen to test the effect of inserting the sulfatase tag into the heavy chain constant region on the antibody's binding to Fc receptors, as well as the effect of conjugating a payload on the tagged antibody's binding to Fc receptors.

Effect of Tag Insertion on Fcγ Binding

The binding of tagged antibodies to FcγRI (CD64) and FcγRIIIa (CD16a) was measured using ELISA (FIG. 10, see columns labeled "mAB"). Antibodies having a sulfatase motif inserted at a position N-terminal and adjacent residue 185V (as described in Examples 1 and 2), and converted to include an formylglycine (fGly) residue, showed reduced binding to both CD16 and CD64 compared to a non-tagged control. Inserting the converted sulfatase at a position N-terminal and adjacent residue 116E reduced binding to CD16, but reduced binding to CD64 only slightly. On the other hand, inserting the converted sulfatase at a position N-terminal and adjacent residue 247S, 268G or 284D increased binding to CD16.

Effect of Payload Conjugation on FcγR Binding

The binding of antibody conjugates to FcγRI (CD64) and FcγRIIIa (CD16a) was measured using ELISA (FIG. 10, see columns labeled "ADC"). The tagged antibody with the 185V insertion maintained reduced binding to CD16 and CD64 regardless of whether a payload was conjugated to the heavy chain or not. On the other hand, the 116E tagged antibody showed an increase in CD16 binding after conjugating a payload compared to before. Similarly, the 227R and 247S insertions resulted in increased CD16 and CD64 binding upon conjugation to a payload, whereas the 268G and 284D insertions maintained higher CD16 binding regardless of whether a payload was conjugated to the heavy chain or not.

pH-Dependent FcRN Binding of Antibody Conjugates

The binding of antibody conjugates to FcRN (neonatal Fc receptor) was measured using ELISA (FIG. 10). Binding to FcRN was markedly increased at pH 5.5 for antibody conjugates having an insertion of the sulfatase motif at 116E, 227R, 247S, 268G and 284D, compared to the untagged control (FIG. 10, "FcRN ADC pH5"). On the other hand, only the 227R and 247S antibody conjugates retained increased binding to FcRN at pH 7.2 (FIG. 10, "FcRN ADC pH7").

Materials and Methods

Fc gamma receptor binding as assessed by ELISA (Enzyme-Linked Immunosorbent Assay)

Purified His-tagged human Fc gamma receptor proteins (Fc gamma RI/CD64, Fc gamma RIIIa/CD16a, and FcRN) were purchased from R&D Systems. Fc gamma proteins were coated overnight onto 96-well Nunc Maxisorp plates at 1 μg/mL in bicarbonate buffer pH 9.0. Then, wells were blocked for 1 h at room temperature with shaking using 200 μL/well casein blocking buffer (Thermo Fisher Pierce).

Test samples included antibodies and ADCs (made from aldehyde-tagged antibodies conjugated to a hydrophobic payload (drug surrogate)). Untagged antibody was used as the positive control for binding. All test/control antibodies had the same variable and constant regions apart from the presence or absence of the aldehyde tag insertion. For assessing binding to CD16a and FcRN, the control antibody was applied to 3 replicate wells at 4 different concentrations: 100, 50, 25, and 12.5 μg/mL and test samples were applied to a single well at 100 μg/mL. For assessing binding to CD64, the control antibody was applied to 3 replicate wells at 4 different concentrations: 10, 5, 2.5, and 1.25 μg/mL and test samples were applied to a single well at 10 μg/mL. FcRN binding was tested at both pH 7.2 (in PBS) and at pH 5.5 (in 20 mM sodium citrate 50 mM sodium chloride, 20/50 buffer). Binding to CD16a and CD64 was tested at pH 7.2 in PBS. In all cases, the designated pH buffer was used for all incubation and washing steps throughout the procedure.

Test samples and control antibody were incubated on the plates at 100 μL/well, with shaking, for 1 h at room temperature. Next, plates were washed either in PBS+0.1% Tween-20 or in 20/50 buffer+0.1% Tween-20, depending upon the desired pH. Secondary antibody (an anti-human F(ab)2-specific horseradish peroxidase conjugate, Thermo Fisher Pierce) was added at a 1:5000 dilution in either PBS or 20/50 buffer at 100 μL/well and allowed to incubate on the plates for 5 min with shaking. Then, plates were washed as before and bound secondary was visualized by using Ultra TMB substrate (100 μL/well; Thermo Fisher Pierce). The reaction was quenched using 2 N sulfuric acid (100 μL/well). Absorbance at 450 nm was read using a SpectraMax M5 plate reader equipped with SoftMax Pro software. The data were plotted as a histogram with the absorbance at 450 nm (in arbitrary units) on they-axis and the name of the Fc gamma receptor on the x-axis (FIG. 10). The untagged antibody results reflect the average absorbance for the wells plated at the same concentration as the test samples (e.g., 100 or 10 μg/mL).

While the present disclosure has been described with reference to the specific embodiments thereof, it should be understood by those skilled in the art that various changes may be made and equivalents may be substituted without departing from the true spirit and scope of the present disclosure. In addition, many modifications may be made to adapt a particular situation, material, composition of matter, process, process step or steps, to the objective, spirit and scope of the present disclosure. All such modifications are intended to be within the scope of the claims appended hereto.

SEQUENCE LISTING (655 sequences)

SEQ ID NO: 1 - protein, 330 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2 - protein, 326 aa, Homo sapiens
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVMHEALHNHYTQKSLSLSPGK

SEQ ID NO: 3 - protein, 377 aa, Homo sapiens
ASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 4 - protein, 327 aa, Homo sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 5 - protein, 336 aa, Artificial sequence
  synthetic polypeptide
LCTPSRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 6 - protein, 336 aa, Artificial sequence
  synthetic polypeptide
ALCTPSRSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7 - protein, 336 aa, Artificial sequence
  synthetic polypeptide
ASTLCTPSRKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8 - protein, 336 aa, Artificial sequence
  synthetic polypeptide
ASTKLCTPSRGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 9 - protein, 336 aa, Artificial sequence
  synthetic polypeptide
ASTKGPLCTPSRSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10 - protein, 336 aa, Artificial sequence
  synthetic polypeptide
ASTKGPSLCTPSRVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11 - protein, 336 aa, Artificial sequence
  synthetic polypeptide
ASTKGPSVLCTPSRFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12 - protein, 336 aa, Artificial sequence
  synthetic polypeptide
ASTKGPSVFPLAPLCTPSRSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13 - protein, 336 aa, Artificial sequence
  synthetic polypeptide
ASTKGPSVFPLAPSLCTPSRSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 14 - protein, 336 aa, Artificial sequence
  synthetic polypeptide
ASTKGPSVFPLAPSSLCTPSRKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15 - protein, 336 aa, Artificial sequence
  synthetic polypeptide
ASTKGPSVFPLAPSSKLCTPSRSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16 - protein, 336 aa, Artificial sequence
  synthetic polypeptide
ASTKGPSVFPLAPSSKSLCTPSRTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17 - protein, 336 aa, Artificial sequence
  synthetic polypeptide
ASTKGPSVFPLAPSSKSTLCTPSRSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18 - protein, 336 aa, Artificial sequence
  synthetic polypeptide
ASTKGPSVFPLAPSSKSTSLCTPSRGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 19 - protein, 336 aa, Artificial sequence
  synthetic polypeptide
ASTKGPSVFPLAPSSKSTSGLCTPSRGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20 - protein, 336 aa, Artificial sequence
  synthetic polypeptide
ASTKGPSVFPLAPSSKSTSGGLCTPSRTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21 - protein, 336 aa, Artificial sequence
  synthetic polypeptide
ASTKGPSVFPLAPSSKSTSGGTLCTPSRAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 22 - protein, 336 aa, Artificial sequence
  synthetic polypeptide
ASTKGPSVFPLAPSSKSTSGGTALCTPSRALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 23 - protein, 336 aa, Artificial sequence
  synthetic polypeptide
ASTKGPSVFPLAPSSKSTSGGTAALCTPSRLGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 24 - protein, 336 aa, Artificial sequence
  synthetic polypeptide
ASTKGPSVFPLAPSSKSTSGGTAALLCTPSRGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 25 - protein, 336 aa, Artificial sequence
  synthetic polypeptide
ASTKGPSVFPLAPSSKSTSGGTAALGCLVKDYFPELCTPSRPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 26 - protein, 336 aa, Artificial sequence
  synthetic polypeptide
ASTKGPSVFPLAPSSKSTSGGTAALGCLVKDYFPEPVTVSLCTPSRWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 27 - protein, 336 aa, Artificial sequence
  synthetic polypeptide
ASTKGPSVFPLAPSSKSTSGGTAALGCLVKDYFPEPVTVSWLCTPSRNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 28 - protein, 336 aa, Artificial sequence
  synthetic polypeptide
ASTKGPSVFPLAPSSKSTSGGTAALGCLVKDYFPEPVTVSWNLCTPSRSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 29 - protein, 336 aa, Artificial sequence
  synthetic polypeptide
ASTKGPSVFPLAPSSKSTSGGTAALGCLVKDYFPEPVTVSWNSLCTPSRGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 30 - protein, 336 aa, Artificial sequence
  synthetic polypeptide
ASTKGPSVFPLAPSSKSTSGGTAALGCLVKDYFPEPVTVSWNSGLCTPSRALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 31 - protein, 336 aa, Artificial sequence
  synthetic polypeptide
ASTKGPSVFPLAPSSKSTSGGTAALGCLVKDYFPEPVTVSWNSGALCTPSRLTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 32 - protein, 336 aa, Artificial sequence
  synthetic polypeptide
ASTKGPSVFPLAPSSKSTSGGTAALGCLVKDYFPEPVTVSWNSGALLCTPSRTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 33 - protein, 336 aa, Artificial sequence
  synthetic polypeptide
ASTKGPSVFPLAPSSKSTSGGTAALGCLVKDYFPEPVTVSWNSGALTLCTPSRSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 34 - protein, 336 aa, Artificial sequence
  synthetic polypeptide
ASTKGPSVFPLAPSSKSTSGGTAALGCLVKDYFPEPVTVSWNSGALTSLCTPSRGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 35 - protein, 336 aa, Artificial sequence
  synthetic polypeptide
ASTKGPSVFPLAPSSKSTSGGTAALGCLVKDYFPEPVTVSWNSGALTSGLCTPSRVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 36 - protein, 336 aa, Artificial sequence
  synthetic polypeptide
ASTKGPSVFPLAPSSKSTSGGTAALGCLVKDYFPEPVTVSWNSGALTSGVLCTPSRHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 37 - protein, 336 aa, Artificial sequence
  synthetic polypeptide
ASTKGPSVFPLAPSSKSTSGGTAALGCLVKDYFPEPVTVSWNSGALTSGVHLCTPSRTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 38 - protein, 336 aa, Artificial sequence
  synthetic polypeptide
ASTKGPSVFPLAPSSKSTSGGTAALGCLVKDYFPEPVTVSWNSGALTSGVHTLCTPSRFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 39 - protein, 336 aa, Artificial sequence
  synthetic polypeptide
ASTKGPSVFPLAPSSKSTSGGTAALGCLVKDYFPEPVTVSWNSGALTSGVHTFPAVLQSLCTPSRSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 40 - protein, 336 aa, Artificial sequence
  synthetic polypeptide
ASTKGPSVFPLAPSSKSTSGGTAALGCLVKDYFPEPVTVSWNSGALTSGVHTFPAVLQSSLCTPSRGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLCTPSRLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 42 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLLCTPSRYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 43 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYLCTPSRSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 44 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLLCTPSRSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 45 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVLCTPSRVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 46 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVLCTPSRTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 47 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTLCTPSRVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 48 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVLCTPSRPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 49 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPLCTPSRSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 50 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSLCTPSRSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 51 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSLCTPSRSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 52 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLCTPSRLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 53 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLLCTPSRGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 54 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGLCTPSRTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 55 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTLCTPSRQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 56 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQLCTPSRTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 57 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTLCTPSRYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 58 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYLCTPSRICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 59 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYILCTPSRCNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 60 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVLCTPSRNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHLCTPSRKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 62 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKLCTPSRPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 63 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPLCTPSRSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 64 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSLCTPSRNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 65 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNLCTPSRTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 66 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTLCTPSRKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 67 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKLCTPSRVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 68 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVLCTPSRDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 69 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKLCTPSRKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 70 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVELCTPSRPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 71 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPLCTPSRKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 72 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKLCTPSRSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 73 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSLCTPSRCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 74 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCLCTPSRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 75 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDLCTPSRKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 76 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKLCTPSRTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 77 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTLCTPSRHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 78 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHLCTPSRTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 79 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTLCTPSRCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 80 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCLCTPSRPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 81 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPLCTPSRCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 82 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCLCTPSRPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 83 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPLCTPSRAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 84 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPALCTPSRPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 85 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPLCTPSRELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 86 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLCTPSRLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 87 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLLCTPSRGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 88 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGLCTPSRPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 89 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPLCTPSRSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 90 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISLCTPSRRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 91 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRLCTPSRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 92 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTLCTPSRPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 93 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVLCTPSRSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 94 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSLCTPSRHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 95 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHLCTPSREDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 96 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHELCTPSRDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 97 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDLCTPSRPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 98 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPLCTPSREVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 99 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKLCTPSRFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 100 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVELCTPSRVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 101 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVLCTPSRHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 102 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHLCTPSRNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 103 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNLCTPSRAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 104 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNALCTPSRKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 105 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKLCTPSRTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 106 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQLCTPSRYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 107 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTLCTPSRYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 108 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYLCTPSRRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 109 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRLCTPSRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 110 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVLCTPSRVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 111 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVLCTPSRSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 112 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNLCTPSRKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 113 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKLCTPSRALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 114 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALCTPSRLPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 115 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPLCTPSRAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 116 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPALCTPSRPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 117 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPLCTPSRIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 118 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISLCTPSRKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 119 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKLCTPSRAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 120 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKLCTPSRGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 121 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGLCTPSRQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 122 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPLCTPSRREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 123 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPRLCTPSREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 124 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPLCTPSRQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 125 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLLCTPSRPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 126 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPLCTPSRPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 127 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPLCTPSRSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 128 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSLCTPSRREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 129 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRLCTPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 130 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRELCTPSREMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 131 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREELCTPSRMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 132 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTLCTPSRKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 133 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKLCTPSRNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 134 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQLCTPSRVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 135 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVLCTPSRSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 136 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKLCTPSRGFYPSDIAVEWESNGQPENNYKTTPPVLDSDGSFFLYSKLTVDKSRWQQGNVFSCSVMHEALHNHYTQKSLSLSPGK

SEQ ID NO: 137 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYLCTPSRPSDIAVEWESNGQPENNYKTTPPVLDSDGSFFLYSKLTVDKSRWQQGNVFSCSVMHEALHNHYTQKSLSLSPGK

SEQ ID NO: 138 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVELCTPSRWESNGQPENNYKTTPPVLDSDGSFFLYSKLTVDKSRWQQGNVFSCSVMHEALHNHYTQKSLSLSPGK

SEQ ID NO: 139 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESLCTPSRNGQPENNYKTTPPVLDSDGSFFLYSKLTVDKSRWQQGNVFSCSVMHEALHNHYTQKSLSLSPGK

SEQ ID NO: 140 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNLCTPSRGQPENNYKTTPPVLDSDGSFFLYSKLTVDKSRWQQGNVFSCSVMHEALHNHYTQKSLSLSPGK

SEQ ID NO: 141 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGLCTPSRQPENNYKTTPPVLDSDGSFFLYSKLTVDKSRWQQGNVFSCSVMHEALHNHYTQKSLSLSPGK

SEQ ID NO: 142 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQLCTPSRPENNYKTTPPVLDSDGSFFLYSKLTVDKSRWQQGNVFSCSVMHEALHNHYTQKSLSLSPGK

SEQ ID NO: 143 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPLCTPSRENNYKTTPPVLDSDGSFFLYSKLTVDKSRWQQGNVFSCSVMHEALHNHYTQKSLSLSPGK

SEQ ID NO: 144 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPELCTPSRNNYKTTPPVLDSDGSFFLYSKLTVDKSRWQQGNVFSCSVMHEALHNHYTQKSLSLSPGK

SEQ ID NO: 145 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENLCTPSRNYKTTPPVLDSDGSFFLYSKLTVDKSRWQQGNVFSCSVMHEALHNHYTQKSLSLSPGK

SEQ ID NO: 146 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNLCTPSRYKTTPPVLDSDGSFFLYSKLTVDKSRWQQGNVFSCSVMHEALHNHYTQKSLSLSPGK

SEQ ID NO: 147 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYLCTPSRKTTPPVLDSDGSFFLYSKLTVDKSRWQQGNVFSCSVMHEALHNHYTQKSLSLSPGK

SEQ ID NO: 148 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKLCTPSRTTPPVLDSDGSFFLYSKLTVDKSRWQQGNVFSCSVMHEALHNHYTQKSLSLSPGK

SEQ ID NO: 149 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTLCTPSRTPPVLDSDGSFFLYSKLTVDKSRWQQGNVFSCSVMHEALHNHYTQKSLSLSPGK

SEQ ID NO: 150 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPLCTPSRPVLDSDGSFFLYSKLTVDKSRWQQGNVFSCSVMHEALHNHYTQKSLSLSPGK

SEQ ID NO: 151 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDLCTPSRSDGSFFLYSKLTVDKSRWQQGNVFSCSVMHEALHNHYTQKSLSLSPGK

SEQ ID NO: 152 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSLCTPSRDGSFFLYSKLTVDKSRWQQGNVFSCSVMHEALHNHYTQKSLSLSPGK

SEQ ID NO: 153 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDLCTPSRGSFFLYSKLTVDKSRWQQGNVFSCSVMHEALHNHYTQKSLSLSPGK

SEQ ID NO: 154 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGLCTPSRSFFLYSKLTVDKSRWQQGNVFSCSVMHEALHNHYTQKSLSLSPGK

SEQ ID NO: 155 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSLCTPSRFFLYSKLTVDKSRWQQGNVFSCSVMHEALHNHYTQKSLSLSPGK

SEQ ID NO: 156 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFLCTPSRFLYSKLTVDKSRWQQGNVFSCSVMHEALHNHYTQKSLSLSPGK

SEQ ID NO: 157 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTLCTPSRVDKSRWQQGNVFSCSVMHEALHNHYTQKSLSLSPGK

SEQ ID NO: 158 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVLCTPSRDKSRWQQGNVFSCSVMHEALHNHYTQKSLSLSPGK

SEQ ID NO: 159 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDLCTPSRKSRWQQGNVFSCSVMHEALHNHYTQKSLSLSPGK

SEQ ID NO: 160 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKLCTPSRSRWQQGNVFSCSVMHEALHNHYTQKSLSLSPGK

SEQ ID NO: 161 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSLCTPSRRWQQGNVFSCSVMHEALHNHYTQKSLSLSPGK

SEQ ID NO: 162 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRLCTPSRWQQGNVFSCSVMHEALHNHYTQKSLSLSPGK

SEQ ID NO: 163 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWLCTPSRQQGNVFSCSVMHEALHNHYTQKSLSLSPGK

SEQ ID NO: 164 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQLCTPSRQGNVFSCSVMHEALHNHYTQKSLSLSPGK

SEQ ID NO: 165 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQLCTPSRGNVFSCSVMHEALHNHYTQKSLSLSPGK

SEQ ID NO: 166 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGLCTPSRNVFSCSVMHEALHNHYTQKSLSLSPGK

SEQ ID NO: 167 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVLCTPSRFSCSVMHEALHNHYTQKSLSLSPGK

SEQ ID NO: 168 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFLCTPSRSCSVMHEALHNHYTQKSLSLSPGK

SEQ ID NO: 169 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSLCTPSRCSVMHEALHNHYTQKSLSLSPGK

SEQ ID NO: 170 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYLCTPSRTQKSLSLSPGK

SEQ ID NO: 171 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTLCTPSRQKSLSLSPGK

SEQ ID NO: 172 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQLCTPSRKSLSLSPGK

SEQ ID NO: 173 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKLCTPSRSLSLSPGK

SEQ ID NO: 174 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLCTPSRLSLSPGK

SEQ ID NO: 175 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLLCTPSRSLSPGK

SEQ ID NO: 176 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLLCTPSRSPGK

SEQ ID NO: 177 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSLCTPSRPGK

SEQ ID NO: 178 - protein, 336 aa, Artificial sequence
  synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPLCTPSRGK

SEQ ID NO: 179 - protein, 8 aa, Artificial sequence
  synthetic polypeptide
  MISC_FEATURE (1)..(1): Xaa at position 1 may be present or absent, and when present may be any amino acid
  MISC_FEATURE (2)..(2): Xaa at position 2 is Cys, Ser, 2-formylglycine, or 2-formylglycine covalently bound to a moiety
  MISC_FEATURE (3)..(3): Xaa at position 3 is any amino acid
  MISC_FEATURE (4)..(4): Xaa at position 4 is Pro or Ala
  MISC_FEATURE (5)..(5): Xaa at position 5 is any amino acid
  MISC_FEATURE (6)..(6): Xaa at position 6 is an aliphatic amino acid or a basic amino acid
XXXXXXAS

SEQ ID NO: 180 - protein, 10 aa, Artificial sequence
  synthetic polypeptide
  MISC_FEATURE (2)..(2): Xaa at position 2 may be present or absent, and when present may be any amino acid
  MISC_FEATURE (3)..(3): Xaa at position 3 is Cys, Ser, 2-formylglycine, or 2-formylglycine covalently bound to a moiety
  MISC_FEATURE (4)..(4): Xaa at position 4 is any amino acid
  MISC_FEATURE (5)..(5): Xaa at position 5 is Pro or Ala
  MISC_FEATURE (6)..(6): Xaa at position 6 is any amino acid
  MISC_FEATURE (7)..(7): Xaa at position 7 is an aliphatic amino acid or a basic amino acid
AXXXXXXSTK

SEQ ID NO: 181 - protein, 10 aa, Artificial sequence
  synthetic polypeptide
  MISC_FEATURE (2)..(2): Xaa at position 2 may be present or absent, and when present may be any amino acid
  MISC_FEATURE (3)..(3): Xaa at position 3 is Cys, Ser, 2-formylglycine, or 2-formylglycine covalently bound to a moiety
  MISC_FEATURE (4)..(4): Xaa at position 4 is any amino acid
  MISC_FEATURE (5)..(5): Xaa at position 5 is Pro or Ala
  MISC_FEATURE (6)..(6): Xaa at position 6 is any amino acid
  MISC_FEATURE (7)..(7): Xaa at position 7 is an aliphatic amino acid or a basic amino acid
TXXXXXXKGP

SEQ ID NO: 182 - protein, 13 aa, Artificial sequence
  synthetic polypeptide
  MISC_FEATURE (2)..(2): Xaa at position 2 may be present or absent, and when present may be any amino acid
  MISC_FEATURE (3)..(3): Xaa at position 3 is Cys, Ser, 2-formylglycine, or 2-formylglycine covalently bound to a moiety
  MISC_FEATURE (4)..(4): Xaa at position 4 is any amino acid
  MISC_FEATURE (5)..(5): Xaa at position 5 is Pro or Ala
  MISC_FEATURE (6)..(6): Xaa at position 6 is any amino acid
  MISC_FEATURE (7)..(7): Xaa at position 7 is an aliphatic amino acid or a basic amino acid
KXXXXXXGPSVFP

SEQ ID NO: 183 - protein, 11 aa, Artificial sequence
  synthetic polypeptide
  MISC_FEATURE (2)..(2): Xaa at position 2 may be present or absent, and when present may be any amino acid
  MISC_FEATURE (3)..(3): Xaa at position 3 is Cys, Ser, 2-formylglycine, or 2-formylglycine covalently bound to a moiety
  MISC_FEATURE (4)..(4): Xaa at position 4 is any amino acid
  MISC_FEATURE (5)..(5): Xaa at position 5 is Pro or Ala
  MISC_FEATURE (6)..(6): Xaa at position 6 is any amino acid
  MISC_FEATURE (7)..(7): Xaa at position 7 is an aliphatic amino acid or a basic amino acid
PXXXXXXSVFP

SEQ ID NO: 184 - protein, 11 aa, Artificial sequence
  synthetic polypeptide
  MISC_FEATURE (2)..(2): Xaa at position 2 may be present or absent, and when present may be any amino acid
  MISC_FEATURE (3)..(3): Xaa at position 3 is Cys, Ser, 2-formylglycine, or 2-formylglycine covalently bound to a moiety
  MISC_FEATURE (4)..(4): Xaa at position 4 is any amino acid
  MISC_FEATURE (5)..(5): Xaa at position 5 is Pro or Ala
  MISC_FEATURE (6)..(6): Xaa at position 6 is any amino acid
  MISC_FEATURE (7)..(7): Xaa at position 7 is an aliphatic amino acid or a basic amino acid
  misc_feature (8)..(8): Xaa can be any naturally occurring amino acid
PSXXXXXXVFP

SEQ ID NO: 185 - protein, 10 aa, Artificial sequence
  synthetic polypeptide
  MISC_FEATURE (2)..(2): Xaa at position 2 may be present or absent, and when present may be any amino acid
  MISC_FEATURE (3)..(3): Xaa at position 3 is Cys, Ser, 2-formylglycine, or 2-formylglycine covalently bound to a moiety
  MISC_FEATURE (4)..(4): Xaa at position 4 is any amino acid
  MISC_FEATURE (5)..(5): Xaa at position 5 is Pro or Ala
  MISC_FEATURE (6)..(6): Xaa at position 6 is any amino acid
  MISC_FEATURE (7)..(7): Xaa at position 7 is an aliphatic amino acid or a basic amino acid
VXXXXXXFPL

SEQ ID NO: 186 - protein, 11 aa, Artificial sequence
  synthetic polypeptide
  MISC_FEATURE (3)..(3): Xaa at position 2 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
  MISC_FEATURE (9)..(9): Xaa at position 9 is Ser or Cys
  MISC_FEATURE (10)..(10): Xaa at position 10 is Ser
  MISC_FEATURE (11)..(11): Xaa at position 11 is Lys or Arg
APXXXXXXXXX

SEQ ID NO: 187 - protein, 11 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
SSXXXXXXKST

SEQ ID NO: 188 - protein, 10 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
CSXXXXXXRS

SEQ ID NO: 189 - protein, 11 aa, Artificial sequence
  synthetic polypeptide
  MISC_FEATURE (1)..(1): Xaa at position 1 is Ser or -
  MISC_FEATURE (2)..(2): Xaa at position 2 is Lys or Arg
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
XXXXXXXXSTS

SEQ ID NO: 190 - protein, 12 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
KSXXXXXXTSGG

SEQ ID NO: 191 - protein, 12 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
  MISC_FEATURE (11)..(11): Xaa at position 11 is Gly or Glu
  MISC_FEATURE (12)..(12): Xaa at position 12 is Gly or -
RSXXXXXXTSXX

SEQ ID NO: 192 - protein, 12 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
KSTXXXXXXSGG

SEQ ID NO: 193 - protein, 12 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
  MISC_FEATURE (11)..(11): Xaa at position 11 is Gly or Glu
  MISC_FEATURE (12)..(12): Xaa at position 12 is Gly or -
RSTXXXXXXSXX

SEQ ID NO: 194 - protein, 11 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
  MISC_FEATURE (9)..(9): Xaa at position 9 is Gly or Glu
  MISC_FEATURE (10)..(10): Xaa at position 10 is Gly or Ser
TSXXXXXXXXT

SEQ ID NO: 195 - protein, 11 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
SGXXXXXXGTA

SEQ ID NO: 196 - protein, 10 aa, Artificial sequence
  synthetic polypeptide
  MISC_FEATURE (2)..(2): Xaa at position 2 may be present or absent, and when present may be any amino acid
  MISC_FEATURE (3)..(3): Xaa at position 3 is Cys, Ser, 2-formylglycine, or 2-formylglycine covalently bound to a moiety
  MISC_FEATURE (4)..(4): Xaa at position 4 is any amino acid
  MISC_FEATURE (5)..(5): Xaa at position 5 is Pro or Ala
  MISC_FEATURE (6)..(6): Xaa at position 6 is any amino acid
  MISC_FEATURE (7)..(7): Xaa at position 7 is an aliphatic amino acid or a basic amino acid
EXXXXXXSTA

SEQ ID NO: 197 - protein, 10 aa, Artificial sequence
  synthetic polypeptide
  MISC_FEATURE (1)..(1): Xaa at position 1 is Gly or Glu
  MISC_FEATURE (2)..(2): Xaa at position 2 is Gly or Ser
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
XXXXXXXXTA

SEQ ID NO: 198 - protein, 11 aa, Artificial sequence
  synthetic polypeptide
  MISC_FEATURE (1)..(1): Xaa at position 1 is - or Glu
  MISC_FEATURE (2)..(2): Xaa at position 2 is Gly or Ser
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
XXTXXXXXXAA

SEQ ID NO: 199 - protein, 11 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
TAXXXXXXALG

SEQ ID NO: 200 - protein, 11 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
AAXXXXXXLGC

SEQ ID NO: 201 - protein, 10 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
ALXXXXXXGC

SEQ ID NO: 202 - protein, 11 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
PEXXXXXXPVT

SEQ ID NO: 203 - protein, 10 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
VSXXXXXXWN

SEQ ID NO: 204 - protein, 11 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
SWXXXXXXNSG

SEQ ID NO: 205 - protein, 11 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
WNXXXXXXSGA

SEQ ID NO: 206 - protein, 10 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
NSXXXXXXGA

SEQ ID NO: 207 - protein, 12 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
NSGXXXXXXALT

SEQ ID NO: 208 - protein, 11 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
GAXXXXXXLTS

SEQ ID NO: 209 - protein, 11 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
GALXXXXXXTS

SEQ ID NO: 210 - protein, 11 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
LTXXXXXXSGV

SEQ ID NO: 211 - protein, 12 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
LTSXXXXXXGVH

SEQ ID NO: 212 - protein, 13 aa, Artificial sequence
  synthetic polypeptide
  MISC_FEATURE (5)..(5): Xaa at position 5 may be present or absent, and when present may be any amino acid
  MISC_FEATURE (6)..(6): Xaa at position 6 is Cys, Ser, 2-formylglycine, or 2-formylglycine covalently bound to a moiety
  MISC_FEATURE (7)..(7): Xaa at position 7 is any amino acid
  MISC_FEATURE (8)..(8): Xaa at position 8 is Pro or Ala
  MISC_FEATURE (9)..(9): Xaa at position 9 is any amino acid
  MISC_FEATURE (10)..(10): Xaa at position 10 is an aliphatic amino acid or a basic amino acid
LTSGXXXXXXVHT

SEQ ID NO: 213 - protein, 11 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
GVXXXXXXHTF

SEQ ID NO: 214 - protein, 11 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
VHXXXXXXTFP

SEQ ID NO: 215 - protein, 11 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
HTXXXXXXFPA

SEQ ID NO: 216 - protein, 10 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
QSXXXXXXSG

SEQ ID NO: 217 - protein, 12 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
QSSXXXXXXGLY

SEQ ID NO: 218 - protein, 13 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
SSGXXXXXXLYSL

SEQ ID NO: 219 - protein, 11 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
GLXXXXXXYSL

SEQ ID NO: 220 - protein, 12 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
LYXXXXXXSLSS

SEQ ID NO: 221 - protein, 11 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
SLXXXXXXSSV

SEQ ID NO: 222 - protein, 12 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
SSVXXXXXXVTV

SEQ ID NO: 223 - protein, 11 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
VVXXXXXXTVP

SEQ ID NO: 224 - protein, 11 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
VVTXXXXXXVP

SEQ ID NO: 225 - protein, 14 aa, Artificial sequence
  synthetic polypeptide
  MISC_FEATURE (5)..(5): Xaa at position 5 may be present or absent, and when present may be any amino acid
  MISC_FEATURE (6)..(6): Xaa at position 6 is Cys, Ser, 2-formylglycine, or 2-formylglycine covalently bound to a moiety
  MISC_FEATURE (7)..(7): Xaa at position 7 is any amino acid
  MISC_FEATURE (8)..(8): Xaa at position 8 is Pro or Ala
  MISC_FEATURE (9)..(9): Xaa at position 9 is any amino acid
  MISC_FEATURE (10)..(10): Xaa at position 10 is an aliphatic amino acid or a basic amino acid
  MISC_FEATURE (14)..(14): Xaa at position 14 is Ser or Asn
VVTVXXXXXXPSSX

SEQ ID NO: 226 - protein, 11 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
VPXXXXXXSSS

SEQ ID NO: 227 - protein, 12 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
  MISC_FEATURE (11)..(11): Xaa at position 11 may be Ser or Asn
  MISC_FEATURE (12)..(12): Xaa at position 12 may be Leu or Phe
VPSXXXXXXSXX

SEQ ID NO: 228 - protein, 14 aa, Artificial sequence
  synthetic polypeptide
  MISC_FEATURE (5)..(5): Xaa at position 5 may be present or absent, and when present may be any amino acid
  MISC_FEATURE (6)..(6): Xaa at position 6 is Cys, Ser, 2-formylglycine, or 2-formylglycine covalently bound to a moiety
  MISC_FEATURE (7)..(7): Xaa at position 7 is any amino acid
  MISC_FEATURE (8)..(8): Xaa at position 8 is Pro or Ala
  MISC_FEATURE (9)..(9): Xaa at position 9 is any amino acid
  MISC_FEATURE (10)..(10): Xaa at position 10 is an aliphatic amino acid or a basic amino acid
  MISC_FEATURE (11)..(11): Xaa at position 11 is Ser or Asn
  MISC_FEATURE (12)..(12): Xaa at position 12 is Leu or Phe
  MISC_FEATURE (13)..(13): Xaa at position 13 is Gly or -
  MISC_FEATURE (14)..(14): Xaa at position 13 is Thr or -
VPSSXXXXXXXXXX

SEQ ID NO: 229 - protein, 12 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
SSSXXXXXXLGT

SEQ ID NO: 230 - protein, 11 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
SSNXXXXXXFG

SEQ ID NO: 231 - protein, 11 aa, Artificial sequence
  synthetic polypeptide
  MISC_FEATURE (1)..(1): Xaa at position 1 is Ser or -
  MISC_FEATURE (2)..(2): Xaa at position 2 is Ser or Asn
  MISC_FEATURE (3)..(3): Xaa at position 3 is Leu or Phe
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
XXXXXXXXXGT

SEQ ID NO: 232 - protein, 12 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
  misc_feature (11)..(11): Xaa can be any naturally occurring amino acid
SLGXXXXXXTXT

SEQ ID NO: 233 - protein, 11 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
FGXXXXXXTQT

SEQ ID NO: 234 - protein, 12 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
  misc_feature (10)..(12): Xaa can be any naturally occurring amino acid
LGTXXXXXXXXX

SEQ ID NO: 235 - protein, 11 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
FGTXXXXXXQT

SEQ ID NO: 236 - protein, 11 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
  misc_feature (11)..(11): Xaa can be any naturally occurring amino acid
TQXXXXXXTYX

SEQ ID NO: 237 - protein, 12 aa, Artificial sequence
  synthetic polypeptide
  misc_feature (4)..(9): Xaa can be any naturally occurring amino acid
GTKXXXXXXTYT

SEQ ID NO: 238 - protein, 11 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
  MISC_FEATURE (10)..(10): Xaa at position 10 is Ile and Thr
  MISC_FEATURE (11)..(11): Xaa at position 11 is - or Cys
QTXXXXXXYXX

SEQ ID NO: 239 - protein, 12 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
TKTXXXXXXYTC

SEQ ID NO: 240 - protein, 11 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
  MISC_FEATURE (9)..(9): Xaa at position 9 is Ile or Thr
  MISC_FEATURE (10)..(10): Xaa at position 10 is Cys
  MISC_FEATURE (11)..(11): Xaa at position 11 is - or Asn
TYXXXXXXXXX

SEQ ID NO: 241 - protein, 10 aa, Artificial sequence
  synthetic polypeptide
  MISC_FEATURE (2)..(2): Xaa at position 2 may be Ile or Thr
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
YXXXXXXXCN

SEQ ID NO: 242 - protein, 11 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
  MISC_FEATURE (9)..(9): Xaa at position 9 is Asn or Asp
  MISC_FEATURE (10)..(10): Xaa at position 10 is His
  MISC_FEATURE (11)..(11): Xaa at position 10 is Lys or -
NVXXXXXXXXX

SEQ ID NO: 243 - protein, 11 aa, Artificial sequence
  synthetic polypeptide
  MISC_FEATURE (1)..(1): Xaa at position 1 is Asn and Asp
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
XHXXXXXXKPS

SEQ ID NO: 244 - protein, 11 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
HKXXXXXXPSN

SEQ ID NO: 245 - protein, 11 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
KPXXXXXXSNT

SEQ ID NO: 246 - protein, 12 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
KPSXXXXXXNTK

SEQ ID NO: 247 - protein, 12 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
PSNXXXXXXTKV

SEQ ID NO: 248 - protein, 11 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
NTXXXXXXKVD

SEQ ID NO: 249 - protein, 13 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
  MISC_FEATURE (13)..(13): Xaa at position 13 is Lys, Thr, or Arg
NTKXXXXXXVDKX

SEQ ID NO: 250 - protein, 11 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
  MISC_FEATURE (11)..(11): Xaa at position 11 is Lys, Thr, or Arg
KVXXXXXXDKX

SEQ ID NO: 251 - protein, 11 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
  misc_feature (9)..(9): Xaa can be any naturally occurring amino acid
DKXXXXXXXVE

SEQ ID NO: 252 - protein, 11 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
VEXXXXXXPKS

SEQ ID NO: 253 - protein, 12 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
VEPXXXXXXKSC

SEQ ID NO: 254 - protein, 11 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
PKXXXXXXSCD

SEQ ID NO: 255 - protein, 11 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
PKSXXXXXXCD

SEQ ID NO: 256 - protein, 11 aa, Artificial sequence
  synthetic polypeptide
  MISC_FEATURE (3)..(3): Xaa at position 2 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
SCXXXXXXDKT

SEQ ID NO: 257 - protein, 11 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
CDXXXXXXKTH

SEQ ID NO: 258 - protein, 11 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
CDKXXXXXXTH

SEQ ID NO: 259 - protein, 10 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
KTXXXXXXHT

SEQ ID NO: 260 - protein, 11 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
THXXXXXXTCP

SEQ ID NO: 261 - protein, 12 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
THTXXXXXXCPP

SEQ ID NO: 262 - protein, 11 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
TCXXXXXXPPC

SEQ ID NO: 263 - protein, 10 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
PPXXXXXXCP

SEQ ID NO: 264 - protein, 12 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
PCXXXXXXPAPE

SEQ ID NO: 265 - protein, 12 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
  MISC_FEATURE (12)..(12): Xaa at position 12 may be Glu or Pro
PCPXXXXXXAPX

SEQ ID NO: 266 - protein, 12 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
SCPXXXXXXAPE

SEQ ID NO: 267 - protein, 12 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
  MISC_FEATURE (11)..(11): Xaa at position 11 is Glu or Pro
  MISC_FEATURE (12)..(12): Xaa at position 12 is Leu or Phe or Val
CPAXXXXXXPXX

SEQ ID NO: 268 - protein, 13 aa, Artificial sequence
  synthetic polypeptide
  MISC_FEATURE (5)..(5): Xaa at position 5 may be present or absent, and when present may be any amino acid
  MISC_FEATURE (6)..(6): Xaa at position 6 is Cys, Ser, 2-formylglycine, or 2-formylglycine covalently bound to a moiety
  MISC_FEATURE (7)..(7): Xaa at position 7 is any amino acid
  MISC_FEATURE (8)..(8): Xaa at position 8 is Pro or Ala
  MISC_FEATURE (9)..(9): Xaa at position 9 is any amino acid
  MISC_FEATURE (10)..(10): Xaa at position 10 is an aliphatic amino acid or a basic amino acid
  MISC_FEATURE (12)..(12): Xaa at position 12 Leu or Phe
CPAPXXXXXXEXL

SEQ ID NO: 269 - protein, 13 aa, Artificial sequence
  synthetic polypeptide
  MISC_FEATURE (5)..(5): Xaa at position 5 may be present or absent, and when present may be any amino acid
  MISC_FEATURE (6)..(6): Xaa at position 6 is Cys, Ser, 2-formylglycine, or 2-formylglycine covalently bound to a moiety
  MISC_FEATURE (7)..(7): Xaa at position 7 is any amino acid
  MISC_FEATURE (8)..(8): Xaa at position 8 is Pro or Ala
  MISC_FEATURE (9)..(9): Xaa at position 9 is any amino acid
  MISC_FEATURE (10)..(10): Xaa at position 10 is an aliphatic amino acid or a basic amino acid
CPAPXXXXXXPVA

SEQ ID NO: 270 - protein, 12 aa, Artificial sequence
  synthetic polypeptide
  MISC_FEATURE (3)..(3): Xaa at position 3 is Leu or Phe
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
PEXXXXXXXLGG

SEQ ID NO: 271 - protein, 10 aa, Artificial sequence
  synthetic polypeptide
  MISC_FEATURE (1)..(1): Xaa at position 1 is Leu or Phe
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
XLXXXXXXGG

SEQ ID NO: 272 - protein, 12 aa, Artificial sequence
  synthetic polypeptide
  MISC_FEATURE (1)..(1): Xaa at position 1 is Leu or Val
  MISC_FEATURE (2)..(2): Xaa at position 2 is Gly or Ala
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
  misc_feature (9)..(9): Xaa can be any naturally occurring amino acid
XXGXXXXXXPSV

SEQ ID NO: 273 - protein, 12 aa, Artificial sequence
  synthetic polypeptide
  MISC_FEATURE (1)..(1): Xaa at position 1is Gly or Ala
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
XGPXXXXXXSVF

SEQ ID NO: 274 - protein, 10 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
ISXXXXXXRT

SEQ ID NO: 275 - protein, 12 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
ISRXXXXXXTPE

SEQ ID NO: 276 - protein, 12 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
RTXXXXXXPEVT

SEQ ID NO: 277 - protein, 12 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 7 is an aliphatic amino acid or a basic amino acid
  MISC_FEATURE (10)..(10): Xaa at position 10 is His or Gln
  MISC_FEATURE (11)..(11): Xaa at position 10 is - or Glu
  MISC_FEATURE (12)..(12): Xaa at position 10 is - or Asp
DVXXXXXXSXXX

SEQ ID NO: 278 - protein, 12 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
  misc_feature (10)..(10): Xaa can be any naturally occurring amino acid
DVSXXXXXXXED

SEQ ID NO: 279 - protein, 11 aa, Artificial sequence
  synthetic polypeptide
  MISC_FEATURE (1)..(1): Xaa at position 1 is - or Val
  MISC_FEATURE (2)..(2): Xaa at position 2 is Ser
  MISC_FEATURE (3)..(3): Xaa at position 3 is His or Gln
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
XXXXXXXXXED

SEQ ID NO: 280 - protein, 10 aa, Artificial sequence
  synthetic polypeptide
  MISC_FEATURE (1)..(1): Xaa at position 1 his His or Gln
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
XEXXXXXXDP

SEQ ID NO: 281 - protein, 11 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
EDXXXXXXPEV

SEQ ID NO: 282 - protein, 11 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
  MISC_FEATURE (11)..(11): Xaa at position 11 is Lys or Gln
DPXXXXXXEVX

SEQ ID NO: 283 - protein, 11 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
EVKXXXXXXFN

SEQ ID NO: 284 - protein, 12 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
  MISC_FEATURE (11)..(11): Xaa at position 11 is Asn or Lys
  MISC_FEATURE (12)..(12): Xaa at position 12 is Trp or -
EVQXXXXXXFXX

SEQ ID NO: 285 - protein, 12 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
GVEXXXXXXVHN

SEQ ID NO: 286 - protein, 12 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
VEVXXXXXXHNA

SEQ ID NO: 287 - protein, 11 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
EVHXXXXXXNA

SEQ ID NO: 288 - protein, 11 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
HNXXXXXXAKT

SEQ ID NO: 289 - protein, 12 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 7 is an aliphatic amino acid or a basic amino acid
NAXXXXXXKTKP

SEQ ID NO: 290 - protein, 11 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
AKXXXXXXTKP

SEQ ID NO: 291 - protein, 11 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
  MISC_FEATURE (9)..(9): Xaa at position 9 is Tyr or Phe
  MISC_FEATURE (10)..(10): Xaa at position 10 is Asn
  MISC_FEATURE (11)..(11): Xaa at position 11 is Ser or -
EQXXXXXXXXX

SEQ ID NO: 292 - protein, 11 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
  MISC_FEATURE (10)..(10): Xaa at position 10 is Tyr or Phe
NSTXXXXXXXR

SEQ ID NO: 293 - protein, 11 aa, Artificial sequence
  synthetic polypeptide
  MISC_FEATURE (3)..(3): Xaa at position 3 is Tyr or Phe
  MISC_FEATURE (4)..(4): Xaa at position 4 may be present or absent, and when present may be any amino acid
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
  misc_feature (9)..(9): Xaa can be any naturally occurring amino acid
STXXXXXXXRV

SEQ ID NO: 294 - protein, 11 aa, Artificial sequence
  synthetic polypeptide
  MISC_FEATURE (1)..(1): Xaa at position 1is Tyr or Phe
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
XRXXXXXXVVS

SEQ ID NO: 295 - protein, 12 aa, Artificial sequence
  synthetic polypeptide
  MISC_FEATURE (1)..(1): Xaa at position 1 is Tyr or Phe
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
XRVXXXXXXVSV

SEQ ID NO: 296 - protein, 12 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
RVVXXXXXXSVL

SEQ ID NO: 297 - protein, 12 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
  MISC_FEATURE (11)..(11): Xaa at position 11 is Ala or Gly
VSNXXXXXXKXL

SEQ ID NO: 298 - protein, 11 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 7 is an aliphatic amino acid or a basic amino acid
  MISC_FEATURE (9)..(9): Xaa at position 9 is Ala or Gly
  MISC_FEATURE (10)..(10): Xaa at position 10 is Leu
  MISC_FEATURE (11)..(11): Xaa at position 11 is pro or -
NKXXXXXXXXX

SEQ ID NO: 299 - protein, 11 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
KAXXXXXXLPA

SEQ ID NO: 300 - protein, 12 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
  MISC_FEATURE (12)..(12): Xaa at position 12 is Ala or Ser
NKGXXXXXXLPX

SEQ ID NO: 301 - protein, 11 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
ALPXXXXXXAP

SEQ ID NO: 302 - protein, 11 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
  MISC_FEATURE (10)..(10): Xaa at position 10 is Ala or Ser
  MISC_FEATURE (11)..(11): Xaa at position 11 is Pro or Ser
GLPXXXXXXXX

SEQ ID NO: 303 - protein, 11 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
LPAXXXXXXPI

SEQ ID NO: 304 - protein, 11 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
LPSXXXXXXSI

SEQ ID NO: 305 - protein, 12 aa, Artificial sequence
  synthetic polypeptide
  MISC_FEATURE (3)..(3): Xaa at position 3 is Ala or Ser
  MISC_FEATURE (4)..(4): Xaa at position 4 is Pro or Ser
  MISC_FEATURE (5)..(5): Xaa at position 5 may be present or absent, and when present may be any amino acid
  MISC_FEATURE (6)..(6): Xaa at position 6 is Cys, Ser, 2-formylglycine, or 2-formylglycine covalently bound to a moiety
  MISC_FEATURE (7)..(7): Xaa at position 7 is any amino acid
  MISC_FEATURE (8)..(8): Xaa at position 8 is Pro or Ala
  MISC_FEATURE (9)..(9): Xaa at position 9 is any amino acid
  MISC_FEATURE (10)..(10): Xaa at position 10 is an aliphatic amino acid or a basic amino acid
LPXXXXXXXXIE

SEQ ID NO: 306 - protein, 12 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
  MISC_FEATURE (11)..(11): Xaa at position 11 is Ala or Thr
  MISC_FEATURE (12)..(12): Xaa at position 11 is - or Lys
TISXXXXXXKXX

SEQ ID NO: 307 - protein, 12 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
  MISC_FEATURE (10)..(10): Xaa at position 10 is Ala or Thr
  MISC_FEATURE (11)..(11): Xaa at position 11 is Lys
  MISC_FEATURE (12)..(12): Xaa at position 11 is - or Gly
ISKXXXXXXXXX

SEQ ID NO: 308 - protein, 14 aa, Artificial sequence
  synthetic polypeptide
  MISC_FEATURE (1)..(1): Xaa at position 1 is - or Ser
  MISC_FEATURE (2)..(2): Xaa at position 2 is Lys
  MISC_FEATURE (3)..(3): Xaa at position 3 is Ala or Thr
  MISC_FEATURE (5)..(5): Xaa at position 5 may be present or absent, and when present may be any amino acid
  MISC_FEATURE (6)..(6): Xaa at position 6 is Cys, Ser, 2-formylglycine, or 2-formylglycine covalently bound to a moiety
  MISC_FEATURE (7)..(7): Xaa at position 7 is any amino acid
  MISC_FEATURE (8)..(8): Xaa at position 8 is Pro or Ala
  MISC_FEATURE (9)..(9): Xaa at position 9 is any amino acid
  MISC_FEATURE (10)..(10): Xaa at position 10 is an aliphatic amino acid or a basic amino acid
XXXKXXXXXXGQPR

SEQ ID NO: 309 - protein, 12 aa, Artificial sequence
  synthetic polypeptide
  MISC_FEATURE (1)..(1): Xaa at position 1 is Ala or Thr
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
XKGXXXXXXQPR

SEQ ID NO: 310 - protein, 11 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
QPXXXXXXREP

SEQ ID NO: 311 - protein, 11 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
QPRXXXXXXEP

SEQ ID NO: 312 - protein, 12 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
REPXXXXXXQVY

SEQ ID NO: 313 - protein, 12 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
YTLXXXXXXPPS

SEQ ID NO: 314 - protein, 12 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
  MISC_FEATURE (12)..(12): Xaa at position 12 is Arg or Gln
TLPXXXXXXPSX

SEQ ID NO: 315 - protein, 12 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
  MISC_FEATURE (10)..(10): Xaa at position 10 is Arg or Gln
  misc_feature (11)..(11): Xaa can be any naturally occurring amino acid
  MISC_FEATURE (12)..(12): Xaa at position 12 is Glu or Asp or -
LPPXXXXXXSXX

SEQ ID NO: 316 - protein, 12 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
  MISC_FEATURE (10)..(10): Xaa at position 10 is Arg or Gln
  MISC_FEATURE (11)..(11): Xaa at position 11 is Glu or Asp
  MISC_FEATURE (12)..(12): Xaa at position 12 is - or Glu
PPSXXXXXXXXX

SEQ ID NO: 317 - protein, 11 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
  MISC_FEATURE (10)..(10): Xaa at position 10 is Glu or Asp
  MISC_FEATURE (11)..(11): Xaa at position 11 is Glu
PSRXXXXXXXX

SEQ ID NO: 318 - protein, 11 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
PSQXXXXXXEE

SEQ ID NO: 319 - protein, 12 aa, Artificial sequence
  synthetic polypeptide
  MISC_FEATURE (1)..(1): Xaa at position 1 is - or Pro
  MISC_FEATURE (2)..(2): Xaa at position 2 is Ser
  MISC_FEATURE (3)..(3): Xaa at position 3 is Arg or Gln
  MISC_FEATURE (5)..(5): Xaa at position 5 may be present or absent, and when present may be any amino acid
  MISC_FEATURE (6)..(6): Xaa at position 6 is Cys, Ser, 2-formylglycine, or 2-formylglycine covalently bound to a moiety
  MISC_FEATURE (7)..(7): Xaa at position 7 is any amino acid
  MISC_FEATURE (8)..(8): Xaa at position 8 is Pro or Ala
  MISC_FEATURE (9)..(9): Xaa at position 9 is any amino acid
  MISC_FEATURE (10)..(10): Xaa at position 10 is an aliphatic amino acid or a basic amino acid
XXXEXXXXXXEM

SEQ ID NO: 320 - protein, 10 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
RDXXXXXXEL

SEQ ID NO: 321 - protein, 12 aa, Artificial sequence
  synthetic polypeptide
  MISC_FEATURE (1)..(1): Xaa at position 1 is Ser or -
  MISC_FEATURE (2)..(2): Xaa at position 2 is Arg or Gln
  MISC_FEATURE (5)..(5): Xaa at position 5 may be present or absent, and when present may be any amino acid
  MISC_FEATURE (6)..(6): Xaa at position 6 is Cys, Ser, 2-formylglycine, or 2-formylglycine covalently bound to a moiety
  MISC_FEATURE (7)..(7): Xaa at position 7 is any amino acid
  MISC_FEATURE (8)..(8): Xaa at position 8 is Pro or Ala
  MISC_FEATURE (9)..(9): Xaa at position 9 is any amino acid
  MISC_FEATURE (10)..(10): Xaa at position 10 is an aliphatic amino acid or a basic amino acid
XXEEXXXXXXMT

SEQ ID NO: 322 - protein, 11 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
DEXXXXXXLTK

SEQ ID NO: 323 - protein, 11 aa, Artificial sequence
  synthetic polypeptide
  MISC_FEATURE (1)..(1): Xaa at position 1 is - or Glu
  MISC_FEATURE (2)..(2): Xaa at position 2 is Met or Leu
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
XXTXXXXXXKN

SEQ ID NO: 324 - protein, 11 aa, Artificial sequence
  synthetic polypeptide
  MISC_FEATURE (1)..(1): Xaa at position 1 is Met or Leu
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
XTKXXXXXXNQ

SEQ ID NO: 325 - protein, 10 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
NQXXXXXXVS

SEQ ID NO: 326 - protein, 12 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
NQVXXXXXXSLT

SEQ ID NO: 327 - protein, 13 aa, Artificial sequence
  synthetic polypeptide
  MISC_FEATURE (6)..(6): Xaa at position 6 may be present or absent, and when present may be any amino acid
  MISC_FEATURE (7)..(7): Xaa at position 7 is Cys, Ser, 2-formylglycine, or 2-formylglycine covalently bound to a moiety
  MISC_FEATURE (8)..(8): Xaa at position 8 is any amino acid
  MISC_FEATURE (9)..(9): Xaa at position 9 is Pro or Ala
  MISC_FEATURE (10)..(10): Xaa at position 10 is any amino acid
  MISC_FEATURE (11)..(11): Xaa at position 11 is an aliphatic amino acid or a basic amino acid
TCLVKXXXXXXGF

SEQ ID NO: 328 - protein, 10 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
FYXXXXXXPS

SEQ ID NO: 329 - protein, 11 aa, Artificial sequence
  synthetic polypeptide
  MISC_FEATURE (1)..(1): Xaa at position 1 is Ala or Ser
  MISC_FEATURE (4)..(4): Xaa at position 4 may be present or absent, and when present may be any amino acid
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
  misc_feature (9)..(9): Xaa can be any naturally occurring amino acid
XVEXXXXXXWE

SEQ ID NO: 330 - protein, 11 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
  MISC_FEATURE (10)..(10): Xaa at position 10 is Asn or Ser
WESXXXXXXXG

SEQ ID NO: 331 - protein, 11 aa, Artificial sequence
  synthetic polypeptide
  MISC_FEATURE (3)..(3): Xaa at position 3 is Asn or Ser
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
ESXXXXXXXGQ

SEQ ID NO: 332 - protein, 11 aa, Artificial sequence
  synthetic polypeptide
  MISC_FEATURE (1)..(1): Xaa at position 1 is - or Glu
  MISC_FEATURE (2)..(2): Xaa at position 2 is Ser
  MISC_FEATURE (3)..(3): Xaa at position 3 is Asn or Ser
  MISC_FEATURE (5)..(5): Xaa at position 5 may be present or absent, and when present may be any amino acid
  MISC_FEATURE (6)..(6): Xaa at position 6 is Cys, Ser, 2-formylglycine, or 2-formylglycine covalently bound to a moiety
  MISC_FEATURE (7)..(7): Xaa at position 7 is any amino acid
  MISC_FEATURE (8)..(8): Xaa at position 8 is Pro or Ala
  MISC_FEATURE (9)..(9): Xaa at position 9 is any amino acid
  MISC_FEATURE (10)..(10): Xaa at position 10 is an aliphatic amino acid or a basic amino acid
XXXGXXXXXXQ

SEQ ID NO: 333 - protein, 11 aa, Artificial sequence
  synthetic polypeptide
  MISC_FEATURE (1)..(1): Xaa at position 1 is Asn or Ser
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
XGQXXXXXXPE

SEQ ID NO: 334 - protein, 12 aa, Artificial sequence
  synthetic polypeptide
  MISC_FEATURE (1)..(1): Xaa at position 1 is Asn or Ser
  MISC_FEATURE (5)..(5): Xaa at position 5 may be present or absent, and when present may be any amino acid
  MISC_FEATURE (6)..(6): Xaa at position 6 is Cys, Ser, 2-formylglycine, or 2-formylglycine covalently bound to a moiety
  MISC_FEATURE (7)..(7): Xaa at position 7 is any amino acid
  MISC_FEATURE (8)..(8): Xaa at position 8 is Pro or Ala
  MISC_FEATURE (9)..(9): Xaa at position 9 is any amino acid
  MISC_FEATURE (10)..(10): Xaa at position 10 is an aliphatic amino acid or a basic amino acid
XGQPXXXXXXEN

SEQ ID NO: 335 - protein, 11 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
QPEXXXXXXNN

SEQ ID NO: 336 - protein, 10 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
ENXXXXXXNY

SEQ ID NO: 337 - protein, 10 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
  misc_feature (10)..(10): Xaa can be any naturally occurring amino acid
NNXXXXXXYX

SEQ ID NO: 338 - protein, 10 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
  misc_feature (9)..(9): Xaa can be any naturally occurring amino acid
NYXXXXXXXT

SEQ ID NO: 339 - protein, 11 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
  misc_feature (9)..(9): Xaa can be any naturally occurring amino acid
NYXXXXXXXTT

SEQ ID NO: 340 - protein, 11 aa, Artificial sequence
  synthetic polypeptide
  MISC_FEATURE (2)..(2): Xaa at position 2 is Lys or Asn
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
YXTXXXXXXTP

SEQ ID NO: 341 - protein, 11 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 7 is an aliphatic amino acid or a basic amino acid
  MISC_FEATURE (11)..(11): Xaa at position 11 is Val or Met
TTPXXXXXXPX

SEQ ID NO: 342 - protein, 10 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
LDXXXXXXSD

SEQ ID NO: 343 - protein, 10 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
DSXXXXXXDG

SEQ ID NO: 344 - protein, 11 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
DSDXXXXXXGS

SEQ ID NO: 345 - protein, 11 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
SDGXXXXXXSF

SEQ ID NO: 346 - protein, 10 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
GSXXXXXXFF

SEQ ID NO: 347 - protein, 10 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
SFXXXXXXFL

SEQ ID NO: 348 - protein, 11 aa, Artificial sequence
  synthetic polypeptide
  MISC_FEATURE (1)..(1): Xaa at position 1 is Lys or Arg
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
XLTXXXXXXVD

SEQ ID NO: 349 - protein, 12 aa, Artificial sequence
  synthetic polypeptide
  MISC_FEATURE (1)..(1): Xaa at position 1 is Lys or Arg
  MISC_FEATURE (5)..(5): Xaa at position 5 may be present or absent, and when present may be any amino acid
  MISC_FEATURE (6)..(6): Xaa at position 6 is Cys, Ser, 2-formylglycine, or 2-formylglycine covalently bound to a moiety
  MISC_FEATURE (7)..(7): Xaa at position 7 is any amino acid
  MISC_FEATURE (8)..(8): Xaa at position 8 is Pro or Ala
  MISC_FEATURE (9)..(9): Xaa at position 9 is any amino acid
  MISC_FEATURE (10)..(10): Xaa at position 10 is an aliphatic amino acid or a basic amino acid
XLTVXXXXXXDK

SEQ ID NO: 350 - protein, 12 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
TVDXXXXXXKSR

SEQ ID NO: 351 - protein, 12 aa, Artificial sequence
  synthetic polypeptide
  MISC_FEATURE (5)..(5): Xaa at position 5 may be present or absent, and when present may be any amino acid
  MISC_FEATURE (6)..(6): Xaa at position 6 is Cys, Ser, 2-formylglycine, or 2-formylglycine covalently bound to a moiety
  MISC_FEATURE (7)..(7): Xaa at position 7 is any amino acid
  MISC_FEATURE (8)..(8): Xaa at position 8 is Pro or Ala
  MISC_FEATURE (9)..(9): Xaa at position 9 is any amino acid
  MISC_FEATURE (10)..(10): Xaa at position 10 is an aliphatic amino acid or a basic amino acid
TVDKXXXXXXSR

SEQ ID NO: 352 - protein, 11 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
DKSXXXXXXRW

SEQ ID NO: 353 - protein, 11 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
KSRXXXXXXWQ

SEQ ID NO: 354 - protein, 10 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  misc_feature (8)..(8): Xaa can be any naturally occurring amino acid
  MISC_FEATURE (9)..(9): Xaa at position 9 is an aliphatic amino acid or a basic amino acid
RWXXXXXXQQ

SEQ ID NO: 355 - protein, 10 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
WQXXXXXXQG

SEQ ID NO: 356 - protein, 11 aa, Artificial sequence
  synthetic polypeptide
  MISC_FEATURE (1)..(1): Xaa at position 1 is - or Trp
  MISC_FEATURE (2)..(2): Xaa at position 2 is Gln
  MISC_FEATURE (3)..(3): Xaa at position 3 is Gln or Glu
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
XXXXXXXXXGN

SEQ ID NO: 357 - protein, 10 aa, Artificial sequence
  synthetic polypeptide
  MISC_FEATURE (1)..(1): Xaa at position 1 is Gln or Glu
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
XGXXXXXXNV

SEQ ID NO: 358 - protein, 11 aa, Artificial sequence
  synthetic polypeptide
  MISC_FEATURE (1)..(1): Xaa at position 1 is Gly or -
  MISC_FEATURE (2)..(2): Xaa at position 2 is Asn
  MISC_FEATURE (3)..(3): Xaa at position 3 is Val or Ile
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
XXXXXXXXXFS

SEQ ID NO: 359 - protein, 12 aa, Artificial sequence
  synthetic polypeptide
  MISC_FEATURE (1)..(1): Xaa at position 1 is Asn or -
  MISC_FEATURE (2)..(2): Xaa at position 2 is Val or Ile
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  misc_feature (7)..(7): Xaa can be any naturally occurring amino acid
  MISC_FEATURE (8)..(8): Xaa at position 8 is Pro or Ala
  MISC_FEATURE (9)..(9): Xaa at position 9 is any amino acid
  MISC_FEATURE (10)..(10): Xaa at position 10 is an aliphatic amino acid or a basic amino acid
XXFXXXXXXSCS

SEQ ID NO: 360 - protein, 10 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
FSXXXXXXCS

SEQ ID NO: 361 - protein, 10 aa, Artificial sequence
  synthetic polypeptide
  MISC_FEATURE (1)..(1): Xaa at position 1 is His or Arg
  MISC_FEATURE (2)..(2): Xaa at position 2 Tyr or Phe
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
XXXXXXXXTQ

SEQ ID NO: 362 - protein, 10 aa, Artificial sequence
  synthetic polypeptide
  MISC_FEATURE (1)..(1): Xaa at position 1 is His or -
  MISC_FEATURE (2)..(2): Xaa at position 2 is Tyr or Phe
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
XXTXXXXXXQ

SEQ ID NO: 363 - protein, 11 aa, Artificial sequence
  synthetic polypeptide
  MISC_FEATURE (1)..(1): Xaa at position 1 is Tyr or Phe
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
XTQXXXXXXKS

SEQ ID NO: 364 - protein, 13 aa, Artificial sequence
  synthetic polypeptide
  MISC_FEATURE (3)..(3): Xaa at position 3 may be present or absent, and when present may be any amino acid
  MISC_FEATURE (4)..(4): Xaa at position 4 is Cys, Ser, 2-formylglycine, or 2-formylglycine covalently bound to a moiety
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amion acid or a basic amino acid
QKXXXXXXSLSLS

SEQ ID NO: 365 - protein, 13 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
QKSXXXXXXLSLS

SEQ ID NO: 366 - protein, 12 aa, Artificial sequence
  synthetic polypeptide
  MISC_FEATURE (4)..(4): Xaa at position 4 may be present or absent, and when present may be any amino acid
  MISC_FEATURE (5)..(5): Xaa at position 5 is Cys, Ser, 2-formylglycine, or 2-formylglycine covalently bound to a moiety
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
KSLXXXXXXSLS

SEQ ID NO: 367 - protein, 12 aa, Artificial sequence
  synthetic polypeptide
  MISC_FEATURE (6)..(6): Xaa at position 6 may be present or absent, and when present may be any amino acid
  MISC_FEATURE (7)..(7): Xaa at position 7 is Cys, Ser, 2-formylglycine, or 2-formylglycine covalently bound to a moiety
  MISC_FEATURE (8)..(8): Xaa at position 8 is any amino acid
  MISC_FEATURE (9)..(9): Xaa at position 9 is Pro or Ala
  MISC_FEATURE (10)..(10): Xaa at position 10 is any amino acid
  MISC_FEATURE (11)..(11): Xaa at position 11 is an aliphatic amino acid or a basic amino acid
KSLSLXXXXXXS

SEQ ID NO: 368 - protein, 11 aa, Artificial sequence
  synthetic polypeptide
  MISC_FEATURE (5)..(5): Xaa at position 5 may be present or absent, and when present may be any amino acid
  MISC_FEATURE (6)..(6): Xaa at position 6 is Cys, Ser, 2-formylglycine, or 2-formylglycine covalently bound to a moiety
  MISC_FEATURE (7)..(7): Xaa at position 7 is any amino acid
  MISC_FEATURE (8)..(8): Xaa at position 8 is Pro or Ala
  MISC_FEATURE (9)..(9): Xaa at position 9 is any amino acid
  MISC_FEATURE (10)..(10): Xaa at position 10 is an aliphatic amino acid or a basic amino acid
  MISC_FEATURE (11)..(11): Xaa at position 11 is Pro or Leu
LSLSXXXXXXX

SEQ ID NO: 369 - protein, 12 aa, Artificial sequence
  synthetic polypeptide
  MISC_FEATURE (1)..(1): Xaa at position 1 is - or Leu
  MISC_FEATURE (2)..(2): Xaa at position 2 is - or Ser
  MISC_FEATURE (3)..(3): Xaa at position 3 is - or Leu
  MISC_FEATURE (4)..(4): Xaa at position 4 is Ser
  MISC_FEATURE (5)..(5): Xaa at position 5 is Pro or Leu
  MISC_FEATURE (6)..(6): Xaa at position 6 may be present or absent, and when present may be any amino acid
  MISC_FEATURE (7)..(7): Xaa at position 7 is Cys, Ser, 2-formylglycine, or 2-formylglycine covalently bound to a moiety
  MISC_FEATURE (8)..(8): Xaa at position 8 is any amino acid
  MISC_FEATURE (9)..(9): Xaa at position 9 is Pro or Ala
  MISC_FEATURE (10)..(10): Xaa at position 10 is any amino acid
  MISC_FEATURE (11)..(11): Xaa at position 11 is an aliphatic amino acid or a basic amino acid
XXXXXXXXXXXG

SEQ ID NO: 370 - protein, 8 aa, Artificial sequence
  synthetic polypeptide
  MISC_FEATURE (1)..(1): Xaa at position 1 may be present or absent, and when present may be any amino acid
  MOD_RES (2)..(2): FORMYLATION
  MISC_FEATURE (3)..(3): Xaa at position 3 is any amino acid
  MISC_FEATURE (4)..(4): Xaa at position 4 is Pro or Ala
  MISC_FEATURE (5)..(5): Xaa at position 5 is any amino acid
  MISC_FEATURE (6)..(6): Xaa at position 6 is an aliphatic amino acid or a basic amino acid
XGXXXXAS

SEQ ID NO: 371 - protein, 10 aa, Artificial sequence
  synthetic polypeptide
  MISC_FEATURE (2)..(2): Xaa at position 2 may be present or absent, and when present may be any amino acid
  MOD_RES (3)..(3)
  MISC_FEATURE (4)..(4): Xaa at position 4 is any amino acid
  MISC_FEATURE (5)..(5): Xaa at position 5 is Pro or Ala
  MISC_FEATURE (6)..(6): Xaa at position 6 is any amino acid
  MISC_FEATURE (7)..(7): Xaa at position 7 is an aliphatic amino acid or a basic amino acid
AXGXXXXSTK

SEQ ID NO: 372 - protein, 10 aa, Artificial sequence
  synthetic polypeptide
  MISC_FEATURE (2)..(2): Xaa at position 2 may be present or absent, and when present may be any amino acid
  MOD_RES (3)..(3)
  MISC_FEATURE (4)..(4): Xaa at position 4 is any amino acid
  MISC_FEATURE (5)..(5): Xaa at position 5 is Pro or Ala
  MISC_FEATURE (6)..(6): Xaa at position 6 is any amino acid
  MISC_FEATURE (7)..(7): Xaa at position 7 is an aliphatic amino acid or a basic amino acid
TXGXXXXKGP

SEQ ID NO: 373 - protein, 13 aa, Artificial sequence
  synthetic polypeptide
  MISC_FEATURE (2)..(2): Xaa at position 2 may be present or absent, and when present may be any amino acid
  MOD_RES (3)..(3)
  MISC_FEATURE (4)..(4): Xaa at position 4 is any amino acid
  MISC_FEATURE (5)..(5): Xaa at position 5 is Pro or Ala
  MISC_FEATURE (6)..(6): Xaa at position 6 is any amino acid
  MISC_FEATURE (7)..(7): Xaa at position 7 is an aliphatic amino acid or a basic amino acid
KXGXXXXGPSVFP

SEQ ID NO: 374 - protein, 11 aa, Artificial sequence
  synthetic polypeptide
  MISC_FEATURE (2)..(2): Xaa at position 2 may be present or absent, and when present may be any amino acid
  MOD_RES (3)..(3): FORMYLATION
  MISC_FEATURE (4)..(4): Xaa at position 4 is any amino acid
  MISC_FEATURE (5)..(5): Xaa at position 5 is Pro or Ala
  MISC_FEATURE (6)..(6): Xaa at position 6 is any amino acid
  MISC_FEATURE (7)..(7): Xaa at position 7 is an aliphatic amino acid or a basic amino acid
PXGXXXXSVFP

SEQ ID NO: 375 - protein, 11 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
PSXGXXXXVFP

SEQ ID NO: 376 - protein, 10 aa, Artificial sequence
  synthetic polypeptide
  MISC_FEATURE (2)..(2): Xaa at position 2 may be present or absent, and when present may be any amino acid
  MOD_RES (3)..(3): FORMYLATION
  MISC_FEATURE (4)..(4): Xaa at position 4 is any amino acid
  MISC_FEATURE (5)..(5): Xaa at position 5 is Pro or Ala
  MISC_FEATURE (6)..(6): Xaa at position 6 is any amino acid
  MISC_FEATURE (7)..(7): Xaa at position 7 is an aliphatic amino acid or a basic amino acid
VXGXXXXFPL

SEQ ID NO: 377 - protein, 11 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
  MISC_FEATURE (9)..(9): Xaa at position 9 is Ser or Cys
  MISC_FEATURE (10)..(10): Xaa at position 9 is Ser
  MISC_FEATURE (11)..(11): Xaa at position 11 is Lys or Arg
APXGXXXXXXX

SEQ ID NO: 378 - protein, 11 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MOD_RES (5)..(5): Xaa at position 5 is any amino acid
  MOD_RES (6)..(6): Xaa at position 6 is Pro or Ala
  MOD_RES (7)..(7): Xaa at position 7 is any amino acid
  MOD_RES (8)..(8): Xaa at position 8 is an aliphatic amino acid or a basic amino acid
SSXGXXXXKST

SEQ ID NO: 379 - protein, 10 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
CSXGXXXXRS

SEQ ID NO: 380 - protein, 11 aa, Artificial sequence
  synthetic polypeptide
  MISC_FEATURE (1)..(1): Xaa at position 1 may be Ser or -
  MISC_FEATURE (2)..(2): Xaa at position 2 may be Lys or Arg
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
XXXGXXXXSTS

SEQ ID NO: 381 - protein, 12 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
KSXGXXXXTSGG

SEQ ID NO: 382 - protein, 12 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
  MISC_FEATURE (11)..(11): Xaa at position 11 is Gly or Glu
  MISC_FEATURE (12)..(12): Xaa at position 11 is Gly or -
RSXGXXXXTSXX

SEQ ID NO: 383 - protein, 12 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
KSTXGXXXXSGG

SEQ ID NO: 384 - protein, 12 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 5 is Pro or Ala
  MISC_FEATURE (8)..(8): Xaa at position 8 is any amino acid
  MISC_FEATURE (9)..(9): Xaa at position 9 is an aliphatic amino acid or a basic amino Acid
  MISC_FEATURE (11)..(11): Xaa at position 11 is Gly or Glu
  MISC_FEATURE (12)..(12): Xaa at position 12 is Gly or -
RSTXGXXXXSXX

SEQ ID NO: 385 - protein, 11 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
  MISC_FEATURE (9)..(9): Xaa at position 9 is Gly or Glu
  MISC_FEATURE (10)..(10): Xaa at position 9 is Gly or Ser
TSXGXXXXXXT

SEQ ID NO: 386 - protein, 11 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
SGXGXXXXGTA

SEQ ID NO: 387 - protein, 10 aa, Artificial sequence
  synthetic polypeptide
  MISC_FEATURE (2)..(2): Xaa at position 2 may be present or absent, and when present may be any amino acid
  MOD_RES (3)..(3): FORMYLATION
  MISC_FEATURE (4)..(4): Xaa at position 4 is any amino acid
  MISC_FEATURE (5)..(5): Xaa at position 5 is Pro or Ala
  MISC_FEATURE (6)..(6): Xaa at position 6 is any amino acid
  MISC_FEATURE (7)..(7): Xaa at position 7 is an aliphatic amino acid or a basic amino acid
EXGXXXXSTA

SEQ ID NO: 388 - protein, 10 aa, Artificial sequence
  synthetic polypeptide
  MISC_FEATURE (1)..(1): Xaa at position 1 is Gly or Glu
  MISC_FEATURE (2)..(2): Xaa at position 2 is Gly or Ser
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
XXXGXXXXTA

SEQ ID NO: 389 - protein, 11 aa, Artificial sequence
  synthetic polypeptide
  MISC_FEATURE (1)..(1): Xaa at position 1 is - or Glu
  MISC_FEATURE (2)..(2): Xaa at position 2 is Gly or Ser
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
XXTXGXXXXAA

SEQ ID NO: 390 - protein, 11 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
TAXGXXXXALG

SEQ ID NO: 391 - protein, 11 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
AAXGXXXXLGC

SEQ ID NO: 392 - protein, 10 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
ALXGXXXXGC

SEQ ID NO: 393 - protein, 11 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
PEXGXXXXPVT

SEQ ID NO: 394 - protein, 10 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
VSXGXXXXWN

SEQ ID NO: 395 - protein, 11 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
SWXGXXXXNSG

SEQ ID NO: 396 - protein, 11 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
WNXGXXXXSGA

SEQ ID NO: 397 - protein, 10 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
NSXGXXXXGA

SEQ ID NO: 398 - protein, 12 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
NSGXGXXXXALT

SEQ ID NO: 399 - protein, 11 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
GAXGXXXXLTS

SEQ ID NO: 400 - protein, 11 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
GALXGXXXXTS

SEQ ID NO: 401 - protein, 11 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
LTXGXXXXSGV

SEQ ID NO: 402 - protein, 12 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
LTSXGXXXXGVH

SEQ ID NO: 403 - protein, 13 aa, Artificial sequence
  synthetic polypeptide
  MISC_FEATURE (5)..(5): Xaa at position 5 may be present or absent, and when present may be any amino acid
  MOD_RES (6)..(6): FORMYLATION
  MISC_FEATURE (7)..(7): Xaa at position 7 is any amino acid
  MISC_FEATURE (8)..(8): Xaa at position 8 is Pro or Ala
  MISC_FEATURE (9)..(9): Xaa at position 9 is any amino acid
  MISC_FEATURE (10)..(10): Xaa at position 10 is an aliphatic amino acid or a basic amino acid
LTSGXGXXXXVHT

SEQ ID NO: 404 - protein, 11 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
GVXGXXXXHTF

SEQ ID NO: 405 - protein, 11 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
VHXXXXXXTFP

SEQ ID NO: 406 - protein, 11 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
HTXXXXXXFPA

SEQ ID NO: 407 - protein, 10 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
QSXGXXXXSG

SEQ ID NO: 408 - protein, 12 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
QSSXGXXXXGLY

SEQ ID NO: 409 - protein, 13 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
SSGXGXXXXLYSL

SEQ ID NO: 410 - protein, 11 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
GLXGXXXXYSL

SEQ ID NO: 411 - protein, 12 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
LYXGXXXXSLSS

SEQ ID NO: 412 - protein, 11 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
SLXGXXXXSSV

SEQ ID NO: 413 - protein, 12 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
SSVXGXXXXVTV

SEQ ID NO: 414 - protein, 11 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
VVXGXXXXTVP

SEQ ID NO: 415 - protein, 11 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
VVTXGXXXXVP

SEQ ID NO: 416 - protein, 14 aa, Artificial sequence
  synthetic polypeptide
  MISC_FEATURE (5)..(5): Xaa at position 5 may be present or absent, and when present may be any amino acid
  MOD_RES (6)..(6): FORMYLATION
  MISC_FEATURE (7)..(7): Xaa at position 7 is any amino acid
  MISC_FEATURE (8)..(8): Xaa at position 8 is Pro or Ala
  MISC_FEATURE (9)..(9): Xaa at position 9 is any amino acid
  MISC_FEATURE (10)..(10): Xaa at position 10 is an aliphatic amino acid or a basic amino acid
  MISC_FEATURE (14)..(14): Xaa at position 14 IS Ser or Asn.
VVTVXGXXXXPSSX

SEQ ID NO: 417 - protein, 11 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
VPXGXXXXSSS

SEQ ID NO: 418 - protein, 12 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
  MISC_FEATURE (11)..(11): Xaa at position 11 is Ser or Asn
  MISC_FEATURE (12)..(12): Xaa at position 12 is Leu or Phe
VPSXGXXXXSXX

SEQ ID NO: 419 - protein, 14 aa, Artificial sequence
  synthetic polypeptide
  MISC_FEATURE (5)..(5): Xaa at position 5 may be present or absent, and when present may be any amino acid
  MOD_RES (6)..(6): FORMYLATION
  MISC_FEATURE (7)..(7): Xaa at position 7 is any amino acid
  MISC_FEATURE (8)..(8): Xaa at position 8 is Pro or Ala
  MISC_FEATURE (9)..(9): Xaa at position 9 is any amino acid
  MISC_FEATURE (10)..(10): Xaa at position 10 is an aliphatic amino acid or a basic amino acid
  MISC_FEATURE (11)..(11): Xaa at position 11 is Ser or Asn
  MISC_FEATURE (12)..(12): Xaa at position 11 is Leu or Phe
  MISC_FEATURE (13)..(13): Xaa at position 11 is Gly or -
  MISC_FEATURE (14)..(14): Xaa at position 11 is Thr or -
VPSSXGXXXXXXXX

SEQ ID NO: 420 - protein, 12 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
SSSXGXXXXLGT

SEQ ID NO: 421 - protein, 11 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
SSNXGXXXXFG

SEQ ID NO: 422 - protein, 11 aa, Artificial sequence
  synthetic polypeptide
  MISC_FEATURE (1)..(1): Xaa at position 1 is Ser or -
  MISC_FEATURE (2)..(2): Xaa at position 2 is Ser or Asn
  MISC_FEATURE (3)..(3): Xaa at position 3 is Leu or Phe
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
XXXXGXXXXGT

SEQ ID NO: 423 - protein, 12 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
  MISC_FEATURE (11)..(11): Xaa at position 11 is Glu or Lys
SLGXGXXXXTXT

SEQ ID NO: 424 - protein, 11 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
FGXGXXXXTQT

SEQ ID NO: 425 - protein, 12 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
  MISC_FEATURE (10)..(10): Xaa at position 10 is Glu or Lys
  MISC_FEATURE (11)..(11): Xaa at position 11 is Thr
  MISC_FEATURE (12)..(2): Xaa at position 12 is - or Tyr
  misc_feature (12)..(12): Xaa can be any naturally occurring amino acid
LGTXGXXXXXXX

SEQ ID NO: 426 - protein, 11 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
FGTXGXXXXQT

SEQ ID NO: 427 - protein, 11 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
  MISC_FEATURE (11)..(11): Xaa at position 11 is Ile or Thr
TQXGXXXXTYX

SEQ ID NO: 428 - protein, 12 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
GTKXGXXXXTYT

SEQ ID NO: 429 - protein, 11 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
  MISC_FEATURE (10)..(10): Xaa at position 10 is Ile or Thr
  MISC_FEATURE (11)..(11): Xaa at position 11 is - or Cys
QTXGXXXXYXX

SEQ ID NO: 430 - protein, 12 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
TKTXGXXXXYTC

SEQ ID NO: 431 - protein, 11 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
  MISC_FEATURE (9)..(9): Xaa at position 9 is Ile or Thr
  MISC_FEATURE (10)..(10): Xaa at position 10 is Cys
  MISC_FEATURE (11)..(11): Xaa at position 11 is - or Asn
TYXGXXXXXXX

SEQ ID NO: 432 - protein, 10 aa, Artificial sequence
  synthetic polypeptide
  MISC_FEATURE (2)..(2): Xaa at position 2 is Ile or Thr
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
YXGXXXXXCN

SEQ ID NO: 433 - protein, 11 aa, Artificial sequence
  synthetic polypeptide
  MISC_FEATURE (3)..(3): Xaa at position 2 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
  MISC_FEATURE (9)..(9): Xaa at position 9 is Asn or Asp
  MISC_FEATURE (10)..(10): Xaa at position 10 is His
  MISC_FEATURE (11)..(11): Xaa at position 11 is Lys or -
NVXGXXXXXXX

SEQ ID NO: 434 - protein, 11 aa, Artificial sequence
  synthetic polypeptide
  MISC_FEATURE (1)..(1): Xaa at position 1 is Asn or Asp
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
XHXGXXXXKPS

SEQ ID NO: 435 - protein, 11 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
HKXGXXXXPSN

SEQ ID NO: 436 - protein, 11 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
KPXGXXXXSNT

SEQ ID NO: 437 - protein, 12 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
KPSXGXXXXNTK

SEQ ID NO: 438 - protein, 12 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
PSNXGXXXXTKV

SEQ ID NO: 439 - protein, 11 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
NTXGXXXXKVD

SEQ ID NO: 440 - protein, 13 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
  MISC_FEATURE (13)..(13): Xaa at position 13 is Lys or Thr or Arg
NTKXGXXXXVDKX

SEQ ID NO: 441 - protein, 11 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 6 is any amino acid
  MISC_FEATURE (6)..(6): Xaa at position 7 is Pro or Ala
  MISC_FEATURE (7)..(7): Xaa at position 8 is any amino acid
  MISC_FEATURE (8)..(8): Xaa at position 9 is an aliphatic amino acid or a basic amino acid
  MISC_FEATURE (11)..(11): Xaa at position 11 is Lys or Thr or Arg
KVXGXXXXDKX

SEQ ID NO: 442 - protein, 11 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
  MISC_FEATURE (9)..(9): Xaa at position 8 i9 is Lys or Thr or Arg
DKXGXXXXXVE

SEQ ID NO: 443 - protein, 11 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MOD_RES (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
VEXGXXXXPKS

SEQ ID NO: 444 - protein, 12 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
VEPXGXXXXKSC

SEQ ID NO: 445 - protein, 11 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
PKXGXXXXSCD

SEQ ID NO: 446 - protein, 11 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
PKSXGXXXXCD

SEQ ID NO: 447 - protein, 11 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
SCXGXXXXDKT

SEQ ID NO: 448 - protein, 11 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
CDXGXXXXKTH

SEQ ID NO: 449 - protein, 11 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
CDKXGXXXXTH

SEQ ID NO: 450 - protein, 10 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
KTXGXXXXHT

SEQ ID NO: 451 - protein, 11 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
THXGXXXXTCP

SEQ ID NO: 452 - protein, 12 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
THTXGXXXXCPP

SEQ ID NO: 453 - protein, 11 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
TCXGXXXXPPC

SEQ ID NO: 454 - protein, 10 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
PPXGXXXXCP

SEQ ID NO: 455 - protein, 12 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
PCXGXXXXPAPE

SEQ ID NO: 456 - protein, 12 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
  MISC_FEATURE (12)..(12): Xaa at position 12 is Glu or Pro
PCPXGXXXXAPX

SEQ ID NO: 457 - protein, 12 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
SCPXGXXXXAPE

SEQ ID NO: 458 - protein, 12 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
  MISC_FEATURE (11)..(11): Xaa at position 11 is Glu or Pro
  MISC_FEATURE (12)..(12): Xaa at position 11 is Leu or Phe or Val
CPAXGXXXXPXX

SEQ ID NO: 459 - protein, 13 aa, Artificial sequence
  synthetic polypeptide
  MISC_FEATURE (5)..(5): Xaa at position 5 may be present or absent, and when present may be any amino acid
  MOD_RES (6)..(6): FORMYLATION
  MISC_FEATURE (7)..(7): Xaa at position 7 is any amino acid
  MISC_FEATURE (8)..(8): Xaa at position 8 is Pro or Ala
  MISC_FEATURE (9)..(9): Xaa at position 9 is any amino acid
  MISC_FEATURE (10)..(10): Xaa at position 10 is an aliphatic amino acid or a basic amino acid
  MISC_FEATURE (12)..(12): Xaa at position 12 is Leu or Phe
CPAPXGXXXXEXL

SEQ ID NO: 460 - protein, 13 aa, Artificial sequence
  synthetic polypeptide
  MISC_FEATURE (5)..(5): Xaa at position 5 may be present or absent, and when present may be any amino acid
  MOD_RES (6)..(6): FORMYLATION
  MISC_FEATURE (7)..(7): Xaa at position 7 is any amino acid
  MISC_FEATURE (8)..(8): Xaa at position 8 is Pro or Ala
  MISC_FEATURE (9)..(9): Xaa at position 9 is any amino acid
  MISC_FEATURE (10)..(10): Xaa at position 10 is an aliphatic amino acid or a basic amino acid
CPAPXGXXXXPVA

SEQ ID NO: 461 - protein, 12 aa, Artificial sequence
  synthetic polypeptide
  MISC_FEATURE (3)..(3): Xaa at position 3 is Leu or Phe
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
PEXXGXXXXLGG

SEQ ID NO: 462 - protein, 10 aa, Artificial sequence
  synthetic polypeptide
  MISC_FEATURE (1)..(1): Xaa at position 1 may be Leu or Phe
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
XLXGXXXXGG

SEQ ID NO: 463 - protein, 12 aa, Artificial sequence
  synthetic polypeptide
  MISC_FEATURE (1)..(1): Xaa at position 1 is Leu or Val
  MISC_FEATURE (2)..(2): Xaa at position 2 is Gly or Ala
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
XXGXGXXXXPSV

SEQ ID NO: 464 - protein, 12 aa, Artificial sequence
  synthetic polypeptide
  MISC_FEATURE (1)..(1): Xaa at position 1 is Gly or Ala
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
XGPXGXXXXSVF

SEQ ID NO: 465 - protein, 10 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
ISXGXXXXRT

SEQ ID NO: 466 - protein, 12 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
ISRXGXXXXTPE

SEQ ID NO: 467 - protein, 12 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
RTXGXXXXPEVT

SEQ ID NO: 468 - protein, 12 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
  MISC_FEATURE (10)..(10): Xaa at position 10 is His or Gln
  MISC_FEATURE (11)..(11): Xaa at position 11 is - or Glu
  MISC_FEATURE (12)..(12): Xaa at position 12 is - or Asp
DVXGXXXXSXXX

SEQ ID NO: 469 - protein, 12 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
  misc_feature (10)..(10): Xaa can be any naturally occurring amino acid
DVSXGXXXXXED

SEQ ID NO: 470 - protein, 11 aa, Artificial sequence
  synthetic polypeptide
  MISC_FEATURE (1)..(1): Xaa at position 1 is - or Val
  MISC_FEATURE (2)..(2): Xaa at position 2 is Ser
  MISC_FEATURE (3)..(3): Xaa at position 3 is His or Gln
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
XXXXGXXXXED

SEQ ID NO: 471 - protein, 10 aa, Artificial sequence
  synthetic polypeptide
  MISC_FEATURE (1)..(1): Xaa at position 1 is His or Gln
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
XEXGXXXXDP

SEQ ID NO: 472 - protein, 11 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
EDXGXXXXPEV

SEQ ID NO: 473 - protein, 11 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
  MISC_FEATURE (11)..(11): Xaa at position 11 is Lys or Gln
DPXGXXXXEVX

SEQ ID NO: 474 - protein, 11 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
EVKXGXXXXFN

SEQ ID NO: 475 - protein, 12 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
  MISC_FEATURE (11)..(11): Xaa at position 11 is Asn or Lys
  MISC_FEATURE (12)..(12): Xaa at position 12 is Trp or -
EVQXGXXXXFXX

SEQ ID NO: 476 - protein, 12 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
GVEXGXXXXVHN

SEQ ID NO: 477 - protein, 12 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
VEVXGXXXXHNA

SEQ ID NO: 478 - protein, 11 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
EVHXGXXXXNA

SEQ ID NO: 479 - protein, 11 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
HNXGXXXXAKT

SEQ ID NO: 480 - protein, 12 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
NAXGXXXXKTKP

SEQ ID NO: 481 - protein, 11 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
AKXGXXXXTKP

SEQ ID NO: 482 - protein, 11 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
  MISC_FEATURE (9)..(9): Xaa at position 9 is Tyr or Phe
  MISC_FEATURE (10)..(10): Xaa at position 10 is Asn
  MISC_FEATURE (11)..(11): Xaa at position 11 is Ser or -
EQXGXXXXXXX

SEQ ID NO: 483 - protein, 11 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
  MISC_FEATURE (10)..(10): Xaa at position 10 is Tyr or Phe
NSTXGXXXXXR

SEQ ID NO: 484 - protein, 11 aa, Artificial sequence
  synthetic polypeptide
  MISC_FEATURE (3)..(3): Xaa at position 3 is Tyr or Phe
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
STXXGXXXXRV

SEQ ID NO: 485 - protein, 11 aa, Artificial sequence
  synthetic polypeptide
  MISC_FEATURE (1)..(1): Xaa at position 1 is Tyr or Phe
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
XRXGXXXXVVS

SEQ ID NO: 486 - protein, 12 aa, Artificial sequence
  synthetic polypeptide
  MISC_FEATURE (1)..(1): Xaa at position 1 is Tyr or Phe
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
XRVXGXXXXVSV

SEQ ID NO: 487 - protein, 12 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
RVVXGXXXXSVL

SEQ ID NO: 488 - protein, 12 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
  MISC_FEATURE (11)..(11): Xaa at position 11 is Ala or Gly
VSNXGXXXXKXL

SEQ ID NO: 489 - protein, 11 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
  MISC_FEATURE (9)..(9): Xaa at position 9 is Ala or Gly
  MISC_FEATURE (10)..(10): Xaa at position 10 is Leu
  MISC_FEATURE (11)..(11): Xaa at position 11 is Pro or -
NKXGXXXXXXX

SEQ ID NO: 490 - protein, 11 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
KAXGXXXXLPA

SEQ ID NO: 491 - protein, 12 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
  MISC_FEATURE (12)..(12): Xaa at position 12 is Ala or Ser
NKGXGXXXXLPX

SEQ ID NO: 492 - protein, 11 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
ALPXGXXXXAP

SEQ ID NO: 493 - protein, 11 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
  MISC_FEATURE (10)..(10): Xaa at position 10 is Ala or Ser
  MISC_FEATURE (11)..(11): Xaa at position 11 is Pro or Ser
GLPXGXXXXXX

SEQ ID NO: 494 - protein, 11 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
LPAXGXXXXPI

SEQ ID NO: 495 - protein, 11 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
LPSXGXXXXSI

SEQ ID NO: 496 - protein, 12 aa, Artificial sequence
  synthetic polypeptide
  MISC_FEATURE (3)..(3): Xaa at position 3 is Ala or Ser
  MISC_FEATURE (4)..(4): Xaa at position 4 is Pro or Ser
  MISC_FEATURE (5)..(5): Xaa at position 5 may be present or absent, and when present may be any amino acid
  MOD_RES (6)..(6): FORMYLATION
  MISC_FEATURE (7)..(7): Xaa at position 7 is any amino acid
  MISC_FEATURE (8)..(8): Xaa at position 8 is Pro or Ala
  MISC_FEATURE (9)..(9): Xaa at position 9 is any amino acid
  MISC_FEATURE (10)..(10): Xaa at position 10 is an aliphatic amino acid or a basic amino acid
LPXXXGXXXXIE

SEQ ID NO: 497 - protein, 12 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
  MISC_FEATURE (11)..(11): Xaa at position 11 is Ala or Thr
  MISC_FEATURE (12)..(12): Xaa at position 12 is - or Lys
TISXGXXXXKXX

SEQ ID NO: 498 - protein, 12 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
  MISC_FEATURE (10)..(10): Xaa at position 10 is Ala or Thr
  MISC_FEATURE (11)..(11): Xaa at position 11 is Lys
  MISC_FEATURE (12)..(12): Xaa at position 12 is - or Gly
ISKXGXXXXXXX

SEQ ID NO: 499 - protein, 14 aa, Artificial sequence
  synthetic polypeptide
  MISC_FEATURE (1)..(1): Xaa at position 1 is - or Ser
  MISC_FEATURE (2)..(2): Xaa at position 2 is Lys
  MISC_FEATURE (3)..(3): Xaa at position 3 is Ala or Thr
  MISC_FEATURE (5)..(5): Xaa at position 5 may be present or absent, and when present may be any amino acid
  MOD_RES (6)..(6): FORMYLATION
  MISC_FEATURE (7)..(7): Xaa at position 7 is any amino acid
  MISC_FEATURE (8)..(8): Xaa at position 8 is Pro or Ala
  MISC_FEATURE (9)..(9): Xaa at position 9 is any amino acid
  MISC_FEATURE (10)..(10): Xaa at position 10 is an aliphatic amino acid or a basic amino acid
XXXKXGXXXXGQPR

SEQ ID NO: 500 - protein, 12 aa, Artificial sequence
  synthetic polypeptide
  MISC_FEATURE (1)..(1): Xaa at position 1 is Ala or Thr
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
XKGXGXXXXQPR

SEQ ID NO: 501 - protein, 11 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
QPXGXXXXREP

SEQ ID NO: 502 - protein, 11 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
QPRXGXXXXEP

SEQ ID NO: 503 - protein, 12 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
REPXGXXXXQVY

SEQ ID NO: 504 - protein, 12 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
YTLXGXXXXPPS

SEQ ID NO: 505 - protein, 12 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
  MISC_FEATURE (12)..(12): Xaa at position 12 is Arg or Gln
TLPXGXXXXPSX

SEQ ID NO: 506 - protein, 12 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
  MISC_FEATURE (11)..(11): Xaa at position 11 is Arg or Gln
  MISC_FEATURE (12)..(12): Xaa at position 12 is Glu or -
LPPXGXXXXSXX

SEQ ID NO: 507 - protein, 12 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
  MISC_FEATURE (10)..(10): Xaa at position 10 is Arg or Gln
  MISC_FEATURE (11)..(11): Xaa at position 11 is Glu or Asp
  MISC_FEATURE (12)..(12): Xaa at position 12 is - or Glu
PPSXGXXXXXXX

SEQ ID NO: 508 - protein, 11 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
  MISC_FEATURE (10)..(10): Xaa at position 10 is Glu or Asp
  MISC_FEATURE (11)..(11): Xaa at position 11 is Glu
PSRXGXXXXXX

SEQ ID NO: 509 - protein, 11 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
PSQXGXXXXEE

SEQ ID NO: 510 - protein, 12 aa, Artificial sequence
  synthetic polypeptide
  MISC_FEATURE (1)..(1): Xaa at position 1 is - or Pro
  MISC_FEATURE (2)..(2): Xaa at position 2 is Ser
  MISC_FEATURE (3)..(3): Xaa at position 3 is Arg or Gln
  MISC_FEATURE (5)..(5): Xaa at position 5 may be present or absent, and when present may be any amino acid
  MOD_RES (6)..(6): FORMYLATION
  MISC_FEATURE (7)..(7): Xaa at position 7 is any amino acid
  MISC_FEATURE (8)..(8): Xaa at position 8 is Pro or Ala
  MISC_FEATURE (9)..(9): Xaa at position 9 is any amino acid
  MISC_FEATURE (10)..(10): Xaa at position 10 is an aliphatic amino acid or a basic amino acid
XXXEXGXXXXEM

SEQ ID NO: 511 - protein, 10 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
RDXGXXXXEL

SEQ ID NO: 512 - protein, 12 aa, Artificial sequence
  synthetic polypeptide
  MISC_FEATURE (1)..(1): Xaa at position 1is Ser or -
  MISC_FEATURE (2)..(2): Xaa at position 1is Arg or Gln
  MISC_FEATURE (5)..(5): Xaa at position 5 may be present or absent, and when present may be any amino acid
  MOD_RES (6)..(6): FORMYLATION
  MISC_FEATURE (7)..(7): Xaa at position 7 is any amino acid
  MISC_FEATURE (8)..(8): Xaa at position 8 is Pro or Ala
  MISC_FEATURE (9)..(9): Xaa at position 9 is any amino acid
  MISC_FEATURE (10)..(10): Xaa at position 10 is an aliphatic amino acid or a basic amino acid
XXEEXGXXXXMT

SEQ ID NO: 513 - protein, 11 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
DEXGXXXXLTK

SEQ ID NO: 514 - protein, 11 aa, Artificial sequence
  synthetic polypeptide
  MISC_FEATURE (1)..(1): Xaa at position 1 is - or Glu
  MISC_FEATURE (2)..(2): Xaa at position 2 is Met or Leu
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
XXTXGXXXXKN

SEQ ID NO: 515 - protein, 11 aa, Artificial sequence
  synthetic polypeptide
  MISC_FEATURE (1)..(1): Xaa at position 1 is Met or Leu
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
XTKXGXXXXNQ

SEQ ID NO: 516 - protein, 10 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
NQXGXXXXVS

SEQ ID NO: 517 - protein, 12 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
NQVXGXXXXSLT

SEQ ID NO: 518 - protein, 13 aa, Artificial sequence
  synthetic polypeptide
  MISC_FEATURE (6)..(6): Xaa at position 6 may be present or absent, and when present may be any amino acid
  MOD_RES (7)..(7): FORMYLATION
  MISC_FEATURE (8)..(8): Xaa at position 8 is any amino acid
  MISC_FEATURE (9)..(9): Xaa at position 9 is Pro or Ala
  MISC_FEATURE (10)..(10): Xaa at position 10 is any amino acid
  MISC_FEATURE (11)..(11): Xaa at position 11 is an aliphatic amino acid or a basic amino acid
TCLVKXGXXXXGF

SEQ ID NO: 519 - protein, 10 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
FYXGXXXXPS

SEQ ID NO: 520 - protein, 11 aa, Artificial sequence
  synthetic polypeptide
  MISC_FEATURE (1)..(1): Xaa at position 1 is Ala or Ser
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
XVEXGXXXXWE

SEQ ID NO: 521 - protein, 11 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
  misc_feature (10)..(10): Xaa can be any naturally occurring amino acid
WESXGXXXXXG

SEQ ID NO: 522 - protein, 11 aa, Artificial sequence
  synthetic polypeptide
  MISC_FEATURE (3)..(3): Xaa at position 3 is Asn or Ser
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
ESXXGXXXXGQ

SEQ ID NO: 523 - protein, 11 aa, Artificial sequence
  synthetic polypeptide
  MISC_FEATURE (1)..(1): Xaa at position 1 is - or Glu
  MISC_FEATURE (2)..(2): Xaa at position 2 is Ser
  MISC_FEATURE (3)..(3): Xaa at position 3 is Asn or Ser
  MISC_FEATURE (5)..(5): Xaa at position 5 may be present or absent, and when present may be any amino acid
  MOD_RES (6)..(6): FORMYLATION
  MISC_FEATURE (7)..(7): Xaa at position 7 is any amino acid
  MISC_FEATURE (8)..(8): Xaa at position 8 is Pro or Ala
  MISC_FEATURE (9)..(9): Xaa at position 9 is any amino acid
  MISC_FEATURE (10)..(10): Xaa at position 10 is an aliphatic amino acid or a basic amino acid
XXXGXGXXXXQ

SEQ ID NO: 524 - protein, 11 aa, Artificial sequence
  synthetic polypeptide
  MISC_FEATURE (1)..(1): Xaa at position 1 is Asn or Ser
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
XGQXGXXXXPE

SEQ ID NO: 525 - protein, 12 aa, Artificial sequence
  synthetic polypeptide
  MISC_FEATURE (1)..(1): Xaa at position 1i s Asn or Ser
  MISC_FEATURE (5)..(5): Xaa at position 5 may be present or absent, and when present may be any amino acid
  MOD_RES (6)..(6): FORMYLATION
  MISC_FEATURE (7)..(7): Xaa at position 7 is any amino acid
  MISC_FEATURE (8)..(8): Xaa at position 8 is Pro or Ala
  MISC_FEATURE (9)..(9): Xaa at position 9 is any amino acid
  MISC_FEATURE (10)..(10): Xaa at position 10 is an aliphatic amino acid or a basic amino acid
XGQPXGXXXXEN

SEQ ID NO: 526 - protein, 11 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
QPEXGXXXXNN

SEQ ID NO: 527 - protein, 10 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
ENXGXXXXNY

SEQ ID NO: 528 - protein, 10 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
  MISC_FEATURE (10)..(10): Xaa at position 10 is Lys or Asn
NNXGXXXXYX

SEQ ID NO: 529 - protein, 10 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
  MISC_FEATURE (9)..(9): Xaa at position 9 is Lys or Asn
NYXGXXXXXT

SEQ ID NO: 530 - protein, 11 aa, Artificial sequence
  synthetic polypeptide
  MISC_FEATURE (3)..(3): Xaa at position 3 is Lys or Asn
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
NYXXGXXXXTT

SEQ ID NO: 531 - protein, 11 aa, Artificial sequence
  synthetic polypeptide
  MISC_FEATURE (2)..(2): Xaa at position 2 is Lys or Asn
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
YXTXGXXXXTP

SEQ ID NO: 532 - protein, 11 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
  misc_feature (11)..(11): Xaa can be any naturally occurring amino acid
TTPXGXXXXPX

SEQ ID NO: 533 - protein, 10 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
LDXGXXXXSD

SEQ ID NO: 534 - protein, 10 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
DSXGXXXXDG

SEQ ID NO: 535 - protein, 11 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
DSDXGXXXXGS

SEQ ID NO: 536 - protein, 11 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
SDGXGXXXXSF

SEQ ID NO: 537 - protein, 10 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
GSXGXXXXFF

SEQ ID NO: 538 - protein, 10 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
SFXGXXXXFL

SEQ ID NO: 539 - protein, 11 aa, Artificial sequence
  synthetic polypeptide
  MISC_FEATURE (1)..(1): Xaa at position 1 is Lys or Arg
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
XLTXGXXXXVD

SEQ ID NO: 540 - protein, 12 aa, Artificial sequence
  synthetic polypeptide
  MISC_FEATURE (1)..(1): Xaa at position 1 is Lys or Arg
  MISC_FEATURE (5)..(5): Xaa at position 5 may be present or absent, and when present may be any amino acid
  MOD_RES (6)..(6): FORMYLATION
  MISC_FEATURE (7)..(7): Xaa at position 7 is any amino acid
  MISC_FEATURE (8)..(8): Xaa at position 8 is Pro or Ala
  MISC_FEATURE (9)..(9): Xaa at position 9 is any amino acid
  MISC_FEATURE (10)..(10): Xaa at position 10 is an aliphatic amino acid or a basic amino acid
XLTVXGXXXXDK

SEQ ID NO: 541 - protein, 12 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
TVDXGXXXXKSR

SEQ ID NO: 542 - protein, 12 aa, Artificial sequence
  synthetic polypeptide
  MISC_FEATURE (5)..(5): Xaa at position 5 may be present or absent, and when present may be any amino acid
  MOD_RES (6)..(6): FORMYLATION
  MISC_FEATURE (7)..(7): Xaa at position 7 is any amino acid
  MISC_FEATURE (8)..(8): Xaa at position 8 is Pro or Ala
  MISC_FEATURE (9)..(9): Xaa at position 9 is any amino acid
  MISC_FEATURE (10)..(10): Xaa at position 10 is an aliphatic amino acid or a basic amino acid
TVDKXGXXXXSR

SEQ ID NO: 543 - protein, 11 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
DKSXGXXXXRW

SEQ ID NO: 544 - protein, 11 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
KSRXGXXXXWQ

SEQ ID NO: 545 - protein, 10 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
RWXGXXXXQQ

SEQ ID NO: 546 - protein, 10 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
WQXGXXXXQG

SEQ ID NO: 547 - protein, 11 aa, Artificial sequence
  synthetic polypeptide
  MISC_FEATURE (1)..(1): Xaa at position 1 is - or Trp
  MISC_FEATURE (2)..(2): Xaa at position 2 is Gln
  MISC_FEATURE (3)..(3): Xaa at position 3 is Gln or Glu
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
XXXXGXXXXGN

SEQ ID NO: 548 - protein, 10 aa, Artificial sequence
  synthetic polypeptide
  MISC_FEATURE (1)..(1): Xaa at position 1 is Gln or Glu
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
XGXGXXXXNV

SEQ ID NO: 549 - protein, 11 aa, Artificial sequence
  synthetic polypeptide
  MISC_FEATURE (1)..(1): Xaa at position 1is Gly or -
  MISC_FEATURE (2)..(2): Xaa at position 2 is Asn
  MISC_FEATURE (3)..(3): Xaa at position 3 is Val or Ile
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
XXXXGXXXXFS

SEQ ID NO: 550 - protein, 12 aa, Artificial sequence
  synthetic polypeptide
  MISC_FEATURE (1)..(1): Xaa at position 1 is Asn or -
  MISC_FEATURE (2)..(2): Xaa at position 2 is Val or Ile
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
XXFXGXXXXSCS

SEQ ID NO: 551 - protein, 10 aa, Artificial sequence
  synthetic polypeptide
  MISC_FEATURE (3)..(3): Xaa at position 3 may be present or absent, and when present may be any amino acid
  MOD_RES (4)..(4)
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
FSXGXXXXCS

SEQ ID NO: 552 - protein, 10 aa, Artificial sequence
  synthetic polypeptide
  MISC_FEATURE (1)..(1): Xaa at position 1 is His or Arg
  MISC_FEATURE (2)..(2): Xaa at position 2 is Tyr or Phe
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
XXXGXXXXTQ

SEQ ID NO: 553 - protein, 10 aa, Artificial sequence
  synthetic polypeptide
  MISC_FEATURE (1)..(1): Xaa at position 1 may be His or -
  MISC_FEATURE (2)..(2): Xaa at position 1 may be Tyr or Phe
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
XXTXGXXXXQ

SEQ ID NO: 554 - protein, 11 aa, Artificial sequence
  synthetic polypeptide
  MISC_FEATURE (1)..(1): Xaa at position 1 may be Tyr or Phe
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
XTQXGXXXXKS

SEQ ID NO: 555 - protein, 13 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
QKXGXXXXSLSLS

SEQ ID NO: 556 - protein, 13 aa, Artificial sequence
  synthetic polypeptide
  MISC_FEATURE (3)..(3): Xaa at position 3 may be present or absent, and when present may be any amino acid
  MOD_RES (4)..(4): FORMYLATION
  MISC_FEATURE (5)..(5): Xaa at position 5 is any amino acid
  MISC_FEATURE (6)..(6): Xaa at position 6 is Pro or Ala
  MISC_FEATURE (7)..(7): Xaa at position 7 is any amino acid
  MISC_FEATURE (8)..(8): Xaa at position 8 is an aliphatic amino acid or a basic amino acid
  misc_feature (9)..(9): Xaa can be any naturally occurring amino acid
QKSXGXXXXLSLS

SEQ ID NO: 557 - protein, 12 aa, Artificial sequence
  synthetic polypeptide
  MISC_FEATURE (4)..(4): Xaa at position 4 may be present or absent, and when present may be any amino acid
  MOD_RES (5)..(5): FORMYLATION
  MISC_FEATURE (6)..(6): Xaa at position 6 is any amino acid
  MISC_FEATURE (7)..(7): Xaa at position 7 is Pro or Ala
  MISC_FEATURE (8)..(8): Xaa at position 8 is any amino acid
  MISC_FEATURE (9)..(9): Xaa at position 9 is an aliphatic amino acid or a basic amino acid
KSLXGXXXXSLS

SEQ ID NO: 558 - protein, 12 aa, Artificial sequence
  synthetic polypeptide
  MISC_FEATURE (5)..(5): Xaa at position 5 may be present or absent, and when present may be any amino acid
  MOD_RES (6)..(6): FORMYLATION
  MISC_FEATURE (7)..(7): Xaa at position 7 is any amino acid
  MISC_FEATURE (8)..(8): Xaa at position 8 is Pro or Ala
  MISC_FEATURE (9)..(9): Xaa at position 9 is any amino acid
  MISC_FEATURE (10)..(10): Xaa at position 10 is an aliphatic amino acid or a basic amino acid
  misc_feature (11)..(11): Xaa can be any naturally occurring amino acid
KSLSLXGXXXXS

SEQ ID NO: 559 - protein, 11 aa, Artificial sequence
  synthetic polypeptide
  MISC_FEATURE (5)..(5): Xaa at position 5 may be present or absent, and when present may be any amino acid
  MOD_RES (6)..(6): FORMYLATION
  MISC_FEATURE (7)..(7): Xaa at position 7 is any amino acid
  MISC_FEATURE (8)..(8): Xaa at position 8 is Pro or Ala
  MISC_FEATURE (9)..(9): Xaa at position 9 is any amino acid
  MISC_FEATURE (10)..(10): Xaa at position 10 is an aliphatic amino acid or a basic amino acid
  misc_feature (11)..(11): Xaa can be any naturally occurring amino acid
LSLSXGXXXXX

SEQ ID NO: 560 - protein, 12 aa, Artificial sequence
  synthetic polypeptide
  MISC_FEATURE (1)..(1): Xaa at position 1 may be - or Leu
  MISC_FEATURE (2)..(2): Xaa at position 2 may be - or Ser
  MISC_FEATURE (3)..(3): Xaa at position 3 may be - or Leu
  MISC_FEATURE (4)..(4): Xaa at position 4 is Ser
  MISC_FEATURE (5)..(5): Xaa at position 5 is Pro or Leu
  MISC_FEATURE (6)..(6): Xaa at position 6 may be present or absent, and when present may be any amino acid
  MOD_RES (7)..(7): FORMYLATION
  MISC_FEATURE (8)..(8): Xaa at position 8 is any amino acid
  MISC_FEATURE (9)..(9): Xaa at position 9 is Pro or Ala
  MISC_FEATURE (10)..(10): Xaa at position 10 is any amino acid
  MISC_FEATURE (11)..(11): Xaa at position 11 is an aliphatic amino acid or a basic amino acid
XXXXXXGXXXXG

SEQ ID NO: 561 - protein, 6 aa, Artificial sequence
  synthetic polypeptide
LCTPSR

SEQ ID NO: 562 - protein, 6 aa, Artificial sequence
  synthetic polypeptide
LSTPSR

SEQ ID NO: 563 - protein, 6 aa, Artificial sequence
  synthetic polypeptide
MCTPSR

SEQ ID NO: 564 - protein, 6 aa, Artificial sequence
  synthetic polypeptide
VCTPSR

SEQ ID NO: 565 - protein, 6 aa, Artificial sequence
  synthetic polypeptide
LCSPSR

SEQ ID NO: 566 - protein, 6 aa, Artificial sequence
  synthetic polypeptide
LCAPSR

SEQ ID NO: 567 - protein, 6 aa, Artificial sequence
  synthetic polypeptide
LCVPSR

SEQ ID NO: 568 - protein, 6 aa, Artificial sequence
  synthetic polypeptide
LCGPSR

SEQ ID NO: 569 - protein, 6 aa, Artificial sequence
  synthetic polypeptide
ICTPAR

SEQ ID NO: 570 - protein, 6 aa, Artificial sequence
  synthetic polypeptide
LCTPSK

SEQ ID NO: 571 - protein, 6 aa, Artificial sequence
  synthetic polypeptide
MCTPSK

SEQ ID NO: 572 - protein, 6 aa, Artificial sequence
  synthetic polypeptide
VCTPSK

SEQ ID NO: 573 - protein, 6 aa, Artificial sequence
  synthetic polypeptide
LCSPSK

SEQ ID NO: 574 - protein, 6 aa, Artificial sequence
  synthetic polypeptide
LCAPSK

SEQ ID NO: 575 - protein, 6 aa, Artificial sequence
  synthetic polypeptide
LCVPSK

SEQ ID NO: 576 - protein, 6 aa, Artificial sequence
  synthetic polypeptide
LCGPSK

SEQ ID NO: 577 - protein, 6 aa, Artificial sequence
  synthetic polypeptide
LCTPSA

SEQ ID NO: 578 - protein, 6 aa, Artificial sequence
  synthetic polypeptide
ICTPAA

SEQ ID NO: 579 - protein, 6 aa, Artificial sequence
  synthetic polypeptide
MCTPSA

SEQ ID NO: 580 - protein, 6 aa, Artificial sequence
  synthetic polypeptide
VCTPSA

SEQ ID NO: 581 - protein, 6 aa, Artificial sequence
  synthetic polypeptide
LCSPSA

SEQ ID NO: 582 - protein, 6 aa, Artificial sequence
  synthetic polypeptide
LCAPSA

SEQ ID NO: 583 - protein, 6 aa, Artificial sequence
  synthetic polypeptide
LCVPSA

SEQ ID NO: 584 - protein, 6 aa, Artificial sequence
  synthetic polypeptide
LCGPSA

SEQ ID NO: 585 - protein, 6 aa, Artificial sequence
  synthetic polypeptide
MSTPSR

SEQ ID NO: 586 - protein, 6 aa, Artificial sequence
  synthetic polypeptide
VSTPSR

SEQ ID NO: 587 - protein, 6 aa, Artificial sequence
  synthetic polypeptide
LSSPSR

SEQ ID NO: 588 - protein, 6 aa, Artificial sequence
  synthetic polypeptide
LSAPSR

SEQ ID NO: 589 - protein, 6 aa, Artificial sequence
  synthetic polypeptide
LSVPSR

SEQ ID NO: 590 - protein, 6 aa, Artificial sequence
  synthetic polypeptide
LSGPSR

SEQ ID NO: 591 - protein, 6 aa, Artificial sequence
  synthetic polypeptide
ISTPAR

SEQ ID NO: 592 - protein, 6 aa, Artificial sequence
  synthetic polypeptide
LSTPSK

SEQ ID NO: 593 - protein, 6 aa, Artificial sequence
  synthetic polypeptide
MSTPSK

SEQ ID NO: 594 - protein, 6 aa, Artificial sequence
  synthetic polypeptide
VSTPSK

SEQ ID NO: 595 - protein, 6 aa, Artificial sequence
  synthetic polypeptide
LSSPSK

SEQ ID NO: 596 - protein, 6 aa, Artificial sequence
  synthetic polypeptide
LSAPSK

SEQ ID NO: 597 - protein, 6 aa, Artificial sequence
  synthetic polypeptide
LSVPSK

SEQ ID NO: 598 - protein, 6 aa, Artificial sequence
  synthetic polypeptide
LSGPSK

SEQ ID NO: 599 - protein, 6 aa, Artificial sequence
  synthetic polypeptide
LSTPSA

SEQ ID NO: 600 - protein, 6 aa, Artificial sequence
  synthetic polypeptide
ISTPAA

SEQ ID NO: 601 - protein, 6 aa, Artificial sequence
  synthetic polypeptide
MSTPSA

SEQ ID NO: 602 - protein, 6 aa, Artificial sequence
  synthetic polypeptide
VSTPSA

SEQ ID NO: 603 - protein, 6 aa, Artificial sequence
  synthetic polypeptide
LSSPSA

SEQ ID NO: 604 - protein, 6 aa, Artificial sequence
  synthetic polypeptide
LSAPSA

SEQ ID NO: 605 - protein, 6 aa, Artificial sequence
  synthetic polypeptide
LSVPSA

SEQ ID NO: 606 - protein, 6 aa, Artificial sequence
  synthetic polypeptide
LSGPSA

SEQ ID NO: 607 - protein, 6 aa, Artificial sequence
  synthetic polypeptide
LGTPSR

SEQ ID NO: 608 - protein, 6 aa, Artificial sequence
  synthetic polypeptide
MGTPSR

SEQ ID NO: 609 - protein, 6 aa, Artificial sequence
  synthetic polypeptide
VGTPSR

SEQ ID NO: 610 - protein, 6 aa, Artificial sequence
  synthetic polypeptide
LGSPSR

SEQ ID NO: 611 - protein, 6 aa, Artificial sequence
  synthetic polypeptide
LGAPSR

SEQ ID NO: 612 - protein, 6 aa, Artificial sequence
  synthetic polypeptide
LGVPSR

SEQ ID NO: 613 - protein, 6 aa, Artificial sequence
  synthetic polypeptide
LGGPSR

SEQ ID NO: 614 - protein, 6 aa, Artificial sequence
  synthetic polypeptide
IGTPAR

SEQ ID NO: 615 - protein, 6 aa, Artificial sequence
  synthetic polypeptide
LGTPSK

SEQ ID NO: 616 - protein, 6 aa, Artificial sequence
  synthetic polypeptide
MGTPSK

SEQ ID NO: 617 - protein, 6 aa, Artificial sequence
  synthetic polypeptide
VGTPSK

SEQ ID NO: 618 - protein, 6 aa, Artificial sequence
  synthetic polypeptide
LGSPSK

SEQ ID NO: 619 - protein, 6 aa, Artificial sequence
  synthetic polypeptide
LGAPSK

SEQ ID NO: 620 - protein, 6 aa, Artificial sequence
  synthetic polypeptide
LGVPSK

SEQ ID NO: 621 - protein, 6 aa, Artificial sequence
  synthetic polypeptide
LGGPSK

SEQ ID NO: 622 - protein, 6 aa, Artificial sequence
  synthetic polypeptide
LGTPSA

SEQ ID NO: 623 - protein, 6 aa, Artificial sequence
  synthetic polypeptide
IGTPAA

SEQ ID NO: 624 - protein, 6 aa, Artificial sequence
  synthetic polypeptide
MGTPSA

SEQ ID NO: 625 - protein, 6 aa, Artificial sequence
  synthetic polypeptide
VGTPSA

SEQ ID NO: 626 - protein, 6 aa, Artificial sequence
  synthetic polypeptide
LGSPSA

SEQ ID NO: 627 - protein, 6 aa, Artificial sequence
  synthetic polypeptide
LGAPSA

SEQ ID NO: 628 - protein, 6 aa, Artificial sequence
  synthetic polypeptide
LGVPSA

SEQ ID NO: 629 - protein, 6 aa, Artificial sequence
  synthetic polypeptide
LGGPSA

SEQ ID NO: 630 - protein, 6 aa, Artificial sequence
  synthetic polypeptide
  MOD_RES (2)..(2): FORMYLATION
LGTPSR

SEQ ID NO: 631 - protein, 6 aa, Artificial sequence
  synthetic polypeptide
  MOD_RES (2)..(2): FORMYLATION
MGTPSR

SEQ ID NO: 632 - protein, 6 aa, Artificial sequence
  synthetic polypeptide
  MOD_RES (2)..(2): FORMYLATION
VGTPSR

SEQ ID NO: 633 - protein, 6 aa, Artificial sequence
  synthetic polypeptide
  MOD_RES (2)..(2): FORMYLATION
LGSPSR

SEQ ID NO: 634 - protein, 6 aa, Artificial sequence
  synthetic polypeptide
LGAPSR

SEQ ID NO: 635 - protein, 6 aa, Artificial sequence
  synthetic polypeptide
  MOD_RES (2)..(2): FORMYLATION
LGVPSR

SEQ ID NO: 636 - protein, 6 aa, Artificial sequence
  synthetic polypeptide
  MOD_RES (2)..(2): FORMYLATION
LGGPSR

SEQ ID NO: 637 - protein, 6 aa, Artificial sequence
  synthetic polypeptide
  MOD_RES (2)..(2): FORMYLATION
IGTPAR

SEQ ID NO: 638 - protein, 6 aa, Artificial sequence
  synthetic polypeptide
  MOD_RES (2)..(2): FORMYLATION
LGTPSK

SEQ ID NO: 639 - protein, 6 aa, Artificial sequence
  synthetic polypeptide
  MOD_RES (2)..(2): FORMYLATION
MGTPSK

SEQ ID NO: 640 - protein, 6 aa, Artificial sequence
  synthetic polypeptide
  MOD_RES (2)..(2): FORMYLATION
VGTPSK

SEQ ID NO: 641 - protein, 6 aa, Artificial sequence
  synthetic polypeptide
  MOD_RES (2)..(2): FORMYLATION
LGSPSK

SEQ ID NO: 642 - protein, 6 aa, Artificial sequence
  synthetic polypeptide
  MOD_RES (2)..(2): FORMYLATION
LGAPSK

SEQ ID NO: 643 - protein, 6 aa, Artificial sequence
  synthetic polypeptide
  MOD_RES (2)..(2): FORMYLATION
LGVPSK

SEQ ID NO: 644 - protein, 6 aa, Artificial sequence
  synthetic polypeptide
  MOD_RES (2)..(2): FORMYLATION
LGGPSK

SEQ ID NO: 645 - protein, 6 aa, Artificial sequence
  synthetic polypeptide
  MOD_RES (2)..(2): FORMYLATION
LGTPSA

SEQ ID NO: 646 - protein, 6 aa, Artificial sequence
  synthetic polypeptide
  MOD_RES (2)..(2): FORMYLATION
IGTPAA

SEQ ID NO: 647 - protein, 6 aa, Artificial sequence
  synthetic polypeptide
  MOD_RES (2)..(2): FORMYLATION
MGTPSA

SEQ ID NO: 648 - protein, 6 aa, Artificial sequence
  synthetic polypeptide
  MOD_RES (2)..(2): FORMYLATION
VGTPSA

SEQ ID NO: 649 - protein, 6 aa, Artificial sequence
  synthetic polypeptide
  MOD_RES (2)..(2): FORMYLATION
LGSPSA

SEQ ID NO: 650 - protein, 6 aa, Artificial sequence
  synthetic polypeptide
  MOD_RES (2)..(2): FORMYLATION
LGAPSA

SEQ ID NO: 651 - protein, 6 aa, Artificial sequence
  synthetic polypeptide
  MOD_RES (2)..(2): FORMYLATION
LGVPSA

SEQ ID NO: 652 - protein, 6 aa, Artificial sequence
  synthetic polypeptide
  MOD_RES (2)..(2): FORMYLATION
LGGPSA

SEQ ID NO: 653 - protein, 8 aa, Artificial sequence
  synthetic polypeptide
DYKDDDDK

SEQ ID NO: 654 - DNA, 27 bp, Artificial sequence
  synthetic oligonucleotide
gggtcgcatacattagtagtggtggtg

SEQ ID NO: 655 - DNA, 27 bp, Artificial sequence
  synthetic oligonucleotide
aaaaccgtctatcagggcgatggccca

What is claimed is:

1. An antibody comprising an immunoglobulin (Ig) heavy chain polypeptide and an Ig light chain polypeptide, wherein:
    the Ig heavy chain polypeptide has 97% or more sequence identity to the amino acid sequence set forth in SEQ ID NO:64, and
    the Ig heavy chain polypeptide comprises an insertion of a sulfatase motif (LCTPSR (SEQ ID NO: 561)) before the asparagine residue at the 91$^{st}$ position of the amino acid sequence set forth in SEQ ID NO: 1 thereby producing in the Ig heavy chain polypeptide the amino acid sequence of KPSX$^1$Z$^1$X$^2$Z$^2$X$^3$Z$^3$NTK (SEQ ID NO: 246), wherein X$^1$ is L, Z$^1$ is C, X$^2$ is T, Z$^2$ is P, X$^3$ is S, and Z$^3$ is R.

2. The antibody of claim 1, wherein Ig heavy chain polypeptide comprises the amino acid sequence of SEQ ID NO: 64.

3. The antibody of claim 1, wherein, in the Ig heavy chain polypeptide, the cysteine residue in the sulfatase motif (LCTPSR (SEQ ID NO: 561)) is oxidized to fGly.

4. The antibody of claim 3, wherein, in the Ig heavy chain polypeptide, fGly is covalently bound to a payload.

5. The antibody of claim 4, wherein the Ig heavy chain polypeptide is covalently bound to the payload via a hydrazone, oxime, semicarbazone, alkyl, alkenyl, acyloxy, hydrazinyl-indolyl, hydrazinyl-imidazoyl, hydrazinyl-pyrrolyl, hydrazinyl-furanyl or a pyrazalinone linkage.

6. The antibody of claim 4, wherein the Ig heavy chain polypeptide is covalently bound to the payload via a linking group.

7. The antibody of claim 6, wherein the linking group comprises a 4-aminopiperidine derivative (4AP).

8. The antibody of claim 4, wherein the payload is selected from a drug, a detectable label, a water-soluble polymer, and a synthetic peptide.

9. The antibody of claim 4, wherein the payload is a small molecule drug.

10. The antibody of claim 9, wherein the small molecule drug is a cancer chemotherapeutic agent selected from the group consisting of an alkylating agent, a nitrosourea, an antimetabolite, an antitumor antibiotic, a vinca alkaloid, and a steroid hormone.

11. The antibody of claim 8, wherein the water-soluble polymer is poly(ethylene glycol).

12. The antibody of claim 8, wherein the detectable label is an imaging agent.

13. The antibody of claim 4, wherein the payload is a viral fusion inhibitor.

14. An antibody comprising an immunoglobulin (Ig) heavy chain polypeptide and an Ig light chain polypeptide, wherein:
    the Ig heavy chain polypeptide has 97% or more sequence identity to the amino acid sequence set forth in SEQ ID NO: 85, and
    the Ig heavy chain polypeptide comprises an insertion of a sulfatase motif (LCTPSR (SEQ ID NO: 561)) before the glutamic acid residue at the 116$^{th}$ position of the amino acid sequence set forth in SEQ ID NO: 1 thereby producing in the Ig heavy chain polypeptide the amino acid sequence of CPAPX$^1$Z$^1$X$^2$Z$^2$X$^3$Z$^3$E[L/F]L (SEQ ID NO: 268), wherein X$^1$ is L, Z$^1$ is C, X$^2$ is T, Z$^2$ is P, X$^3$ is S, and Z$^3$ is R.

15. The antibody of claim 14, wherein Ig heavy chain polypeptide comprises the amino acid sequence of SEQ ID NO: 85.

16. The antibody of claim 14, wherein, in the Ig heavy chain polypeptide, the cysteine residue in the sulfatase motif (LCTPSR (SEQ ID NO: 561)) is oxidized to fGly.

17. The antibody of claim 16, wherein, in the Ig heavy chain polypeptide, fGly is covalently bound to a payload.

18. The antibody of claim 17, wherein the Ig heavy chain polypeptide is covalently bound to the payload via a hydrazone, oxime, semicarbazone, alkyl, alkenyl, acyloxy, hydrazinyl-indolyl, hydrazinyl-imidazoyl, hydrazinyl-pyrrolyl, hydrazinyl-furanyl or a pyrazalinone linkage.

19. The antibody of claim 17, wherein the Ig heavy chain polypeptide is covalently bound to the payload via a linking group.

20. The antibody of claim 19, wherein the linking group comprises a 4-aminopiperidine derivative (4AP).

21. The antibody of claim 17, wherein the payload is selected from a drug, a detectable label, a water-soluble polymer, and a synthetic peptide.

22. The antibody of claim 17, wherein the payload is a small molecule drug.

23. The antibody of claim 22, wherein the small molecule drug is a cancer chemotherapeutic agent selected from the group consisting of an alkylating agent, a nitrosourea, an antimetabolite, an antitumor antibiotic, a vinca alkaloid, and a steroid hormone.

24. The antibody of claim 21, wherein the water-soluble polymer is poly(ethylene glycol).

25. The antibody of claim 21, wherein the detectable label is an imaging agent.

26. The antibody of claim 17, wherein the payload is a viral fusion inhibitor.

* * * * *